United States Patent 11,583,558 (METHODS AND COMPOSITIONS FOR TREATMENT OF MICROBIOME-ASSOCIATED DISORDERS) - sequence listing, part 11

SEQ ID NO: 10 - DNA, 6402828 bp, Clostridium indolis WBS-01 (residues 4,268,553-6,402,828 of 6,402,828)
gatcgaaaaatacttaagcaatcatgaatgatatgtgaaaatactgtgttttcgaggcggagactaccattggcgacaatggaggctccgcctcttgtacgtgggttacggttctgccatgcaggaacaataccataacgtacgagacaaagaaatttgggacaaaaggttttccagcatgttcctttatgatatactatatactgcggactaaggtacacacaggtaaaaaagaagggaaaatcaaatggcatttacacatttacacgtccatacggaatacagcctgttggacggctcctgtaagataaaagaacttgtgtccagggcaaaggagcttggaatggacagcatggccatcacggatcatggcgtgatgtacggcgtcattgatttttacagggcggccagagaggcgggaataaaacccatcatcgggtgtgaggtatatgtgacttccggatccaggtttgacagggaaaccgtgggcggcgaggaccggtactatcatctggtcttattggctgagaataaccagggataccagaacctgatgaagatcgtctcaaagggctttgtggatggattttattataaaccaagagttgattatgaagttttaaaagaatacagtgaagggatcattgcattaagtgcctgtctggcaggagaggtacagaggctggtcagccgcggccagtatgaaaagggcgtggaaaccgctctccgctatcaggagatattcgggaaggggaatttcttcttagagcttcaggatcatgggataccggcgcagaatacggtgaatcagggccttctgcggatgagccatgaaacagggatcgatctggtggcgaccaatgatattcactatacctatgcagaggatgccactccccacgacatcctgctgtgcatccagaccggaaaaaaggtggctgatgaaaaccgcatgcgctatgaaggcggccagtattactgcaaatccgaagaggagatgcggaagcttttctcctacgcaggagaagccattgacaacacctacaagatcgcagagcggtgcaatgtggaaatcgagttcggcgtgaccaagctgcccaaatacgatgtgccggaaggatatgattcctggtcgtatttgaataagctttgcctggatggctttgagcgccattatccccaggctgaggtcacattaaaagaaaggcttgactatgagctggatgtcattcacaccatgggatatgtggactatttcctgatcgtatgggatttcatccactatgccagatccagggacatcatcgtggggccgggacgaggttctgcggcaggaagtattgtatcctactgcctggggatcaccaacatcgatcccatccgctacaacctgctgtttgagcggttcttaaatccggaacgtatttccatgcctgatattgatgtggatttctgctttgaacgacggcaggaggtcattgactatgtggtcgaaaaatacgggaaggaccaggtggttcagatcgtgacctttggtactctggccgccaagggtgtggtcagggatgtgggaagggtgcttgacatgccctatgcccggtgcgacgccatagcaaagatgatacccggagatcttggcatgacccttgaaaaggctttaaggcaaagccctgacttaagaaatgcatacgaaggggatccggaggtcaaatacctcattgatatgtccatgcgtctggaaggactgccgagacatacctccatgcatgccgccggagttgttatcagccagacctcagtagatgaatatgttcccctttccaaagcagctgacggaaccattaccacacagtttaccatgacgaccctggaagaactggggcttttaaaaatggatttcctgggactgcgcaccctgacggtcatccagaatgcggtgaaagccattgagaaaaacaggaacttgatcctggatatagaccggatcgattataatgataaggcggttttaaattccataggaaccggaagggatgatggggtgttccagctggaaagttccggcatgaagagctttatgaaggagctgaagccggaaagcctggaagatattatcgccgggatttccctttaccgcccaggccccatggactttatccccaaatatttaaaagggaagaatgaccggaattccattacctatgaatgcacccagctggaacctatcctggatccgacctatggctgtatcgtgtaccaggagcaggtaatgcagatcgtaagggacctggccggatataccatgggccgcagcgacctggtgcgcagagccatgtcaaaaaagaaaacctctgtcatggaaaaggagaggcagaactttgtttatggaaatccggaggaggaagtgacagggtgcatccccaatggaatcgatgaaaaaacggcaaaccacatctatgatgagatgattgattttgctaaatacgcctttaacaagtcccatgcagcagcctatgcggtggtgtcttatcagaccgcttttttgaaatattattatccccaggaattcatggcggccctcctcacctctgttatggacaatgtatccaaggtatcggaatacattctaagctgcaggcagatggggatatccatccttccgccggatatcaatgaaggagaaagcggattttccgtttccggaagatcaatacgctatggtctgtctgccattaagagcgtgggaaaatccgtggttgagcttattgtggcggagcgggagcaaaacggtctgtatcacgatatggaagattttatagaccggatgagcaataaggaggtcaacaaaagaactctggaaaatttcataaaatcaggagcattggatacccttcctggtacaagaaagcagaaacttctgaccgcgccggatcttttggaacagagaagcaaggaacggaagaataccatggaaggccagatgaccttgtttgatattgcaggggaagaagaaaagactcattttcaggtgacctttcccgatgtaggggaatttttaaaggaagaccttcttgcatttgaaaaggagacccttggcatctatttaagcggccatcccatggaagccttcgaatccacctggagaaataatatcaccgcaaccacaatagattttgttgtggatgaggaaacgggaaaagccggtgtggctgacggtgcttatgtgaccattggaggcatgattaccggaaaaactgtaaaaactaccagaaataataagatgatggcatttatcaccttggaagacctggcaggggcagtggaagtgatcgtgttcccaaaggattatgagagcaagagagacctttttgtggaggactccaaggtattcatacagggaagagtatcggtaggagaagacccggtgggaaagctgatctgtgagcgggtgaccccattctcagccctgccaaaggagctgtggctgaaattttctgataaggaaacctatatggccgtggaaagagaaattttagatgatttaaaagaatcggaaggtgatgattccgtcatcatttatctggaaaaagagcgggccagaaaggtcttgccggctaaccggaatgtaaatgcggcgggaagactcatcgatgcactggtaaaaaaacttggtgaaaaaaatgtcaggctcgtagaaaaaaaacttgaaaagattggtaaaatgaattagaatacaacgtgtatgcaatgagaaacttacaaaaacagatatccgtgaatcaggaggaagctactatggcaaaacaagtgaaaaccatcggcgtattaaccagcggcggcgatgcaccaggtatgaatgctgcgatccgtgctattgtcaggactgcaatccataagggattggaagtaaaggggatcatgaggggatacgcaggccttctgcaggaagaaatcgttgatatgaccagcaccagtgtatccgatatcatccaccggggcggaaccgttttatatacagccagatgccaggagttcaccactgccgaggggcagaaaaagggcgctgagatctgcagaaagcataatattgacggcatagtggtcattggaggagacggatcattcaggggagcaggaaagctttctgcccttggaatcaataccatcggacttcccggaaccattgatttggatattgcctgtaccgattataccattggctttgacacggctgtcaacacggctatggaggccattgataaggtacgtgatacatctacctcccatgaacgctgcagcatcattgaggtaatgggacgtaatgcaggctatattgccctttggtgcggttttgccaacggcgcagaagatattcttttaccggagcgctatgacggggatgagcaggctctcatcaaccgtatcattgagaacagaaaacggggcaaaaagcaccacatcatcatcaatgcagaggggatcggccattcttcttccatggcaaagaggattgaggcggcaacaggcattgagaccagagccaccatactgggtcatatgcagaggggcggcgctcctacctgtaaggaccgtgtctatgcttccatcatgggcgcaagggcagtggaacttctctgtgagggaaagagtaaccgtgtaataggatataagcatggagaattcgtggatctggatattcaggaagcccttagcatgacaaaggacatccctgaggatcagtaccggatctgcaaaatgcttgtgagataaggaaacagcggaaggtttgacggccggaagaatacaggcctgtagatatggaaggggacggaagagatggaatatgggggaatcaggcaaaactttgaaaaacacgggttttccacccagcttttctccactaaggaagcagcacgggattatctagtgtctgccctgaaaaatcagaccattggatttggaggaagtgtgacccttcaggagatgggcttatttgaagcgctgcagcaaaccaatgccgtggtatggcacaacaaggtaccttccagggatgtgcggtacatggccagttgtgcgaacatctatataaccagcgccaatgccgtaacagaaggcgggcagatcgtaaacattgacgggacaggaaaccgggtcgctatgaccgcttttggtccccagacatgctattatgttgtgggcaaaaataaaatcaccccaaacctagaaaaggccatttaccggtgcaggaatgtggctgctccgcaaaatgcccggagaatcaatgcaaagactccatgcgccaggaatgcagacaagtgctatgactgcagcagcccagcccgcatctgccgaataacggcagtcattgaccgggcgcctatgggcatgaagtgtgaagtcatctttgtggatgaggtattgggatattaataaaagaattcggcgagagcaaacgggacttttcagtgaaatcccggctgtttcccgcctttttttgtatgggaacaataagaatttttctttaaggggatttgacaaccggaatctttccggttatgctgatataaggatgaccgcaaatggatgggaaagcctcgcgaatatccgattaacaagggacaggaagcaaggagagaaagaacatggatgtaattgaaaagtatatcaatgaactgatggaaaagagtacgccggaccgtccggtatggaacatcgagaaactgctccagggagagaaggccggctggaattacatagacggctgtatgatcaaatccattttagaaatgtacgccatcaccggagatttaaaatatctggattttgccgacacatttattgattaccgggtgagagaggatggaaccatagatggctatgatgtggaggaacggaatatcgataatgtcaatgcaggaaaaaccctgtttgagctttacgatctgacgggaaaagaaaaatacagaaaggccattgatctggtttacagccagatcgggaagatgccccggacaaaagagggaaacttctggcacaagaacatttatccaaaccaggtatggctggacggcctgtacatgtgccagccattttatatggaatatgagacccggtttcataataagaagaactgcggagatatttacagccagtttgccaatgtggtaaagctcatgagggatacggagaccgggctttattaccatgcatatgattcctccagggaaatgttctggtgcgataagatgacaggactgtcccagaatttctggctgagagccttaggctggtacgccatggctcttctggataccatggacaaatcagacaagtcagacggagaaagcttaaagcacatggaagaagcgttccgggacctgattgactccatgctgaaataccaggatgaaggcggtatgtggtatcaggtggtaaacttagggggcatggaccggaattacctggagaccagcggaagcgccattttttcctatgctattttaaagggagtccgtctaggctatcttccggaatcttacgctgtatatgggaaaaaggctttccagggaatctgccggacctatcttcatctggaggaagggaatatgagcctgggagggatctgcctggtggcaggacttggcggcaaagataagagaaacggaacttatgactattacatgtccgagcctgttgtaaaagatgatgccaagggagtaggccccttccttcttgcctatacggaaatgagaagaaccggatgggtatataataaataagaaaacaggaaaataaatggggattgcggcgccggctgaccgggctgcaatccccatttattttaacttaagctgttctgcgcatatttctttggtgaaatccccacttttttcgtaaatgctttaaaaaagttgctgtaatcattaaaaccgcacatgctgtaagcctcattgacgctgtaaccgcctgacaatagtctctgagccagctcgatgcggcaggaaatgatataggaattgatggtggtgccggtgctttttttaaaaagcctgcaaaggtaagaggtgcttaaataaaaatgagctgcaatttctcctatgcttaattgagaatcaatgttgtgatgaatataggtgatgatatcggtcaccttactgctgtaatactgcctatgcaatttcgattctactccaggaaaagtctctgtggccagttttgtcaggaaaaccatgaactcggcaaatgcagcccgctcttccacatcttgtccgaatccgccttctacggccaatttgttaaaataatacttaaaacgccgctgctgtccctggtttaaggggaggtgatgggaaaacctcttcggcctgtgggtaaaacagtaggtcagatccgtctgcggcgtagagatgctttccaaataagaaggatcgatgtatatgacaaatttttcgtggggaatggaagaatcgatctgcagaacctggtgtttttcatattgattgatcatgaacaggctccccggttccatccggtaatttttatcatctataaaaaacgtgcaccctccgctggcggaaaagtaaagttcatggcagcggtggctgtgcatgcttaaaactcctggatccttatggagatgtacaatggagaaggatcgggaggccatgcagtggtcgattccgtcggaaaaagaagtaagtactttcataagctgtaattcccttaactaaatttactaaaactataccataggatgtcaacatttgcaatgttttgtgctgaatttgaaatgaattatcaaggaatggatgttataataagaaaaaagcacagtgtaagcgcttacgcaaagaagcgaaaaaaatgtcgaaaaagtgaaaatgcttacacattgcttttaagaactcatttatgagggagaagaaaaaggagagagaatcatgaaaaaaatcaaacagtgggcggcaatggggttagcaactgttatggcagtgtcattaagcgcctgcggtggaagcaagagcaccagtgaaacaacttcagcatcagctgaaacaacttcagcagcggcaggtgagaccacaacagcagccgcaactacaacaggagagccggtagagcttaagttttcctggtggggcggtgacagcagacatgctgctacagaagaggcgattaaggcatttgaagcaaaatatccgaacatcaaggtaactcctgagtatggcgcatggaccggctgggaagagaagcagtccttaaatattttaggcggtaatgccgcagacgttatgcagatcaactggaactggatcgaatcctacagccagggcggaaaagcctttgcaaacctggaagattattcagatgttcttgatttaaagcagtttacaccggaaagccttgacctttgcaaggttgacgataagttaatggcagtgcccatttccttaacaggacgtgtgttctactggaataagacagcctttgaagaagtaggctgtgacattcctactgacttagattccctgtatgctgcaggtgaagccttcaaagctaaggatcctgatatgtatcccttagcccttggcgaatatgaccgtatgattttaatggtttattatctggaatccaagtacggcaaaaactgggttgaaggcggcgaggtcaactatacggaagaagaagtgaaagacggaatggatttcatgactgagctggaaacaaagcatgtcattcctaacatggcaactctccggggcgatatggccgattctcttgacaaaaacgcaaaatggatcgacggcaagtatgcaggcatctttgagtgggattcctctgcttccaaattccagagtgcgctggaaggcagcgtaaataaacctggccaggaattcgtggttggagatttcgttaagatgggcgattataacggaggcttcacaaagatttccatggcatttgcagttgccggaaattccgagcatccaaaggaagcagctatgctgatcgatttcctgttaaatgatgaggaaggcgttaagatctgctccactgagagaggaattccctgttctactgagggcttaaagattctggaagccaacaagcttggcgatcctctgactattgaagctaacacaaaggttatgggttacagcaaattcagtctggacagcaaatttgagcacaatgacttaaaggcaaatccggacggtgtttactataaggtatttggtaagttaagtacaggagaaatcgattccactcaggcagcaagtgagctgatcaagggaattaccgagactcttgaaggttaataagaaattcagacagtttgaataaatgttacatattcctatgagccgccatagatttatggcggctcccataaagaaaagggcgggcagagtcatggaatgcagagatgagatatggaagccgtatcagctgacgggagccatacagatgtatgaggctactggagaagaggtctataaggatttaacgatggctggtctgaacaggctggaagagatatcagaaggtctgccggtacaggatggcctggcctatttttttgctttggatcagacgggtaatgagaaatacagacaaaagatagaaacactggtcagccagtatgattggacgccggaatttatgccctttgtgacggcatatgagaccaggtataaaagaaaagaacattataatgagattgcagcgttgtttcgtaagaaaaaaggatttacaggatgtgatctggtggctcttatagaaacagtctgtcagatgtcagaagaaatctatgaatattacagggaattaagggatttatttaagactgtgatcaaggggaagataaaagaactcccggattcttctgaatccctggaaatcggttattccatcttaagggcatgtaatacaggcgtgcttcaaagggagaaatacagcggtttcggggaacttatatggaaaatgattgagagtaacaataaaaatacatgcgcgggcttacaggaaatgctcaaagcgcaacataccatattaaaaaaacaggggtataagcatgaagtcaaagggtatccgccaggtcctggcagataatgcaggattctttttcgtcttaccatggctgatcggatttatactgttcaaggtttatccgttcgcctcttcactgtactatagctttacgaactatgacctgtttaacggaattacaaaaacaggcatgatgaattacaataagatattcaccgattccgatattaaaaaggcgttttttgttacgttcaaatatgcgatttttgatgtgccgttaaagcttatgttcgcattattcgttgcatacatactgaactttaaactgaaaggagtcaatttcttccgtaccgcatattatattccttcgattctgggcggatccattgccatcgctatcctgtggagagccgtattcaacacagacggtctgatcaatgcagcccttggcgtatttggttttgaaaagatcaactggatggcaagcgggggaggcgcaatggctgttatcgtactcttaagagtctggcagtttggctctgccatggttattttccttgcggccttaaagggcgtttccgaggatctgtatgaggcagcttccattgacggggcaggaaaatggacacagttctttaaaatcaccgtgcccttaatcacaccggttattttctataacctgatcacccagctgtgccaggcgttccaggaattcaacggaccattccttgtaacaaagggcggaccggacggagcaaccactttaatctccattttgatttacaacaatgcattcctgcgtcacaagatgggtatggcaagtgcacaggcatggatgctgttcctcattgtcatgacctttacagcggtagcatttataagccagaagaaatgggtttactattcagatgaggacgggaggtagataatatgacgagagagacaaagagaaagatcagtgcagtcatccgttatacattgctgattgcagttggccttgttatggtatatcctttagtctggatggtgggtgctacctttaagacaaattcggaaattttcaccagtgcctggttctggcctaaaaagcctgtatccgacggttataccaacgcatttgtagattacggcggaaagatcaatctgatcaaatccatgctcaatacttataaaataattgcaccaaaggttctttttacagtggtttccgctacgattacggcttatggtttcggaaggtttgaattcaagggaaaaggaatcctgttttctcttatgatttccaccctgttcctgccccaggtagtcttaaatgcccccagtatatcatgtttaataaatggggctggaccaattcctacttaccgctggtgattccatccctgtttgcaggcgatacgtactttttgttcatgctgattcagtttttaagaggcgtgccaaaggaattggaagaagccgccaagatcgatggctgcagttccattaaaaccttgtggtatgtgattgtccctatgttaaagccatctctggtctctgttgcactgttccagttcatgtggacttccaatgactttatgggaccgcttatttatatttccgatatgcccaaatatacaaactccatttatttgcgcatgtccatggatggtgatgtgggattccagtggaaccggattttggcaatgtccttgatctccatcattccttccctgatcgtattcttctgcgcccaggaagcctttattgacggcatcgcggccggaggagttaagggataattaaaaaacgggcgtagtatatcattgctgtgccctctgcgttaaggaagtatggctgctttggcagccgtgctccggcgcgagagtctgcattgcaggctctttatttatatcatgggaaaatgcagaacagactcttgattctataggagataaggtttttgagaagaaaattaacaggggaggtcagaaccagtatggaattaaaaattgtctttaaaacggcacggtctgtgaccgtggaaacggtgacccggcagctctatgaatttgaaacgccgggaaagatcctggtaaacggaaaagaatttggagaaacaaagcgggtcatatttaccctgtttgacttaaagccggatatggattataatatttctctggaaagaaatggagaaagagcggaagtaagcttccgtactgattatgaatttgtgacgttaaatgtaaaagatgttggggcgaaaggagatgggatccagaatgacacctcctttatccaggctgctatcatggcctgcccaaaggatagccgggtattgataccaaaaggaaggtaccggataaccagcttattcttaaagagccatttaaggcttgagctggcagaaggagcagagcttttggcggatacggaccggtacaaatatcccagatttcccggaatgattgaaagctatgacgaaaaagaggattataatctgggaacatgggaaggaaatccactccccatgtttgcagggatcataactggaatcgatgcagaggatgtggtgatttatggccctggcctgatcaatggacaggcttcctttgacaactggtgggacaatgtccgccagatgaaggtggcattccgcccccgcaccgtatttttggagaggtgtaaaaacgtggtccttcagggcttttccttaaaaaacagccctgcctgggtgcttcatccatatttcagccaggatttaaaattcttaaatctggatattgaaaatccggcggattctcccaacaccgatggcctggacccggaatcctgcaaggatgtggaaatactgggcctgcatttttctttaggagacgactgcattgcggtcaagtccggaaaaatatacatgggccgtaaatatcagacaccgtctgaaaacatcctgatccgccagtgccttatggaaaacggtcacggggccgttaccgtgggaagcgaagtgggcgcaggcgttaaaaatatccgggtggagtgctgtctgttccgtaatacggacagaggcctccggatcaagacaagaagaggcagaggaaaggattctgtgctttctgatatttattttgaccatatccacatggatcacgttatgacgccttttgttgtaaacagcttttatttctgtgatcccgacggaaagtccgattatgtacagtgccgtgaggccctgaccgtggatgagaggacccctgagatcaagaggctttcctttaccaacattaaggcggaaaactgccatgtggcggcttccttcctctatgggcttccggaaaggaaaattgaacgaattgaatttaaaaacgttgatatttcctttgctgacaatgcaaaggcaggagcgcccgccatgctgtcgggagtggaagattgcaggaaaaaaggctttctcatcagcaatgtggataccctgatctgtgatcatgtgaagatttccggacaggaaggggaagcctttgagctgagtgacatcaatcattatgaagtgagataaaggaggagttattatgcagattggaatccggttacacgatgtggcaccagggaccctggaggaacgggtgaagaccgcccatgagcaggggtttacctgtgtccatttggccctggcaaagacagtaaaagagcattccgtggagaattccgccctgacaccgggatatgccacttatttgcgtaagaagtttgcggagcatgatgtggatattgcagtcctgggctgctatttgaatctggcccatccggacccagaagaaatcaaaaagatccaggagcgttatttcgcccatctgcgttttgcttctatgttgggctgcagcgttgttggaaccgaaacaggtgcgcctaatgaggagtatcgttatgagccggcctgtcactcggaggaagcgcttcagacttttatcacaaatctgcggccggttgtggaatgtgcggaaaagttcggggtgatcattgctattgagccggtgtggagtcacattgtatataactccaagcaggcactgaaggtgcttaaggctattggctcgcctaatttaagaattatcctggatccggtaaatcttttgtcagcggaaaacagtgaacagtatgagcaggtgattgcagaggccattgaggatttaggccggtatacggatgtcctacatatgaaagattttgtggtggaaaacggccggatcgtttccggcgctccgggaaccggagtcatgaaatatgatgtgatcatggattttgtgaaaaaagaaaagccgtatattcagatgaccattgaggacagcaagccggataatgcggagtggtccagggaatttcttgaaaattatggcggttaagaaggtaaactgaaaaagaaaacagataatttttttcatgaaaaatcaaaaacaccgatatctccaatcctggtgataccggtgtttgttttctcaggtcactgtgctatatgaattacttatattgatcagtttaagcaatccttcataacttcataagcgcctttttcttttaagtcttttaaataccctgtcacggcatcttcaaatcctgtaatttcacttaaatcctcatcccagaaatcagcattggtgcaaactgcatgaacaagggaagctgcatcgtcatctttgtgatcatagaagaactgaaggatcggcttatcatccttgacggtgtattcgtcaccggcaggacgtgctgcaacaaggccgtcatccgtgagattcattccgttgtagaatgcgatgtaaaaagcaaaggaggctgttatgcatttgggaagcgtgcctgtgttttccacataactcttaagagaaggcataacccgggctttccatttggaagtggaatttaaagaaatggataacagggcatgatcaataaacgggtttttaaagcgctctgtaacagaggctgcaaaactcattaattcttcttttgggagagtcagggtagggatgatctcatcgtaaatggtcttattcatgaagccgcagatcacttcgtcctccatacagttgcggacaatatcctgtcccgcaaggtaagcgcctaatacaaaggaggtgtgggcaccgtttaatatgcggacttttctctgcttatatggcttatggtcgttacagatgataacaggaaggcctgcttcttcaaagggcagttctttctttaagctgtccggtccctcgatgacccagaatccaaagacttcgcctgtatcaatgatgttatcctcatagcctaattcctcgcaaatggcagcagcttcatttctcggatacccggtaacgatgcggtctaccagagtggagcagaagatgttctctgctttgatccagtcaatgaattccccccaaggttccattgctcagcgtattttaaaacacatttttccagttcttttccgttattatctatcagctcgcaggagaggatgacaaaaccctttccagtttcctttcccaacttttcaaatcttctgtaaaggaactgagtcagttttccagggtagctgtcagccgggacatctgtaaactggcaggaaggatcataggtaatacctgcttcggtggtattgcaggcaataaaacgcagatcaggattatccgcacaggcaagtacggtctcataatccgtataaggatttaagcatctgcttacacaggagatcacacgcttgtcatttaccttctgcccgttttcaaaaccacggaggaaaagagtataaagtccttcctgttggttgatcatatctgcgagacctggtgcaatgggctggcataagacaaccttggagttgaatccggtcttttcattcaaaacgtcgataaagtagtccacaaacgcccttaagaagttaccctcgccgaactgcagcacacgctcaggagcctcctttaaaaggtatccgtcaaacccaagcttttccagtgtttcataacataacttttccattgaatttatctccttttttcttcattgcatagttcaattcccattctggattcataaatgaacacagaatgacatagtagttgaattataaggtcacaccctgtttaaagatagccatgtcgtggaagcctgcctcttcggatttcacctttttgccggaagccacttcaatgacaaaatcaaagaattggtttttaagggtatccatatccgtatcctccaccagtactccgcagttaaaatcaatccagttattcttctttgtgcttaaggcggtgttggtggaaatcttcatggtaggcaccggacaggcaaatggggttccgcggcctgtagtaaacaggacaatgtgggcgccggaagcggccagagccgtagaggccactaagtcattgcctggagcgcttaagagatttaaccccttggtacgtaccggttctccgtattttaagacatccatgaccggagcgctgccggatttctggacgcagcctaaggatttgtcttccagtgtggagatgccgccctttttgttgcctggggagggattttcgtatatggtctggttatggctggtaaaatagtttttaaaatcattgattaagtccacggtcttttcaaagacttcttcattctggctgcggttcatgagaagggtttccgcaccgaacatttcgggaacctctgtcagaatggtggttccgcccttggaaaccagcatatcggaaaatgcccctaccgtgggattggctgtaattccggataaaccgtcggaaccgccgcatttcataccgatgacgagttcgctgcagcttatgggctccctgcggaacgtggctgcatattcagccagctgcccaatgagctccatggcatcagccatttcatcctcggactcctgagctgccaggaactttaccctgcgttcatcgtaatctccgatatagggtttcagctcggcaatgttgctgttttcacagccaaggcccaggaccagaacaccgcctgcatttggatggttgatcaaatcagccagaatggtccgggtatattcctggtcatcgcccatctgggaacagccatagggatgtggaaatgccgcaacctcgtcaatggtgccgccaacgtacttctttgccatgcgttccagtgcagtggctatgttattgacacagccaaccgtaggaatgatccagatttcattgcgcacgcccacttttccctccggtctgcggtaaccctgaaagaatcgttcggcagtaggagcaacggctgtttcctgtctgtcgtaagtataagtcagtaaatcccccaaacctgtttttaaattgtgtgtgtgaatccaggcccctgtcttaatatcttcctttgccatgccaatggcacagccgtatttgatgacggatgagccggcaggtatatcggcgagggcaaacttgtggccctgtggaatatcttccagaagcgtaacagtgtttccgtcaatctccgcggcagtgccggaagaaagcggttttaatgcgactgcaacattgtctccggaatgaattttgataaaatcctgcataagcttcctttcctttcttcgtatcattttccattgatacacgtaatgtaagtacttacataaaacatacactattttagtgtatacgtcaatagggaaagaaaaaaagagatttttctttttatttaaaggaatagattaagaaaaataaaagatttttcttagattaaatcagcaataacagttgctttactaaaaattatcttgtataatggatcaggaaaagtgtaagcgcttacgctcacttgacccgtggaaattttataatgctaaagggacaaccaggatgaacatttatgatattgcagagcttgcaggagtttccatcgctaccgtgtctcgggtggtgaacgacagcccccgtgtgagtgagagaacaaagcagaaggtcagagcgattatggaggagaacggctacactcccaatgtatttgccaggggattggggcttgattcaatgaaaaccatcgggattttatgtcctgatgtgtcagatgcctatatggctacagcggtagcacatttagagagccgcatgcatgagcatggttatgattgtattttgtgctgcagcggatttgaacagtcagttaaggaaaaatatgtcagccttcttcttgccaagcggatcgatgcgctcattatggttggttccacttatgcagggacaggggaagcggataaaaaaacacagtatgtccgggatgcggcaaagcaggttcctgtgttcctgatcaatggttatctggacagtgaaaatgtatactgcgcttatggggatgattatcaggcaacctacagcgtaaccagccagatgattgagacagggcggcagcggatcttgtttctctgcgattcccgctcttacagcgcaactcagaaactggcaggctatgaagccgctttaaaagctcacggacttccggtgcttggagatttaaagctttatgtaaagaaccggatccatacggtaagagatattcttctggagcgccgtgatttaaaatttgacagcgtggttgcctctgatgacggccttgctgtgggagcgattaaatatgccaattcaaaacttttaaagattccggaagatctgtgcattaccggatttaataattctgccctgtccatatgcagcgatcctgagctttcttccattgataacagggtggaggaactatgcaacatcaccgttgataatatgatgaagatccttttgggagaaaagacagaagtcagcaggaacagccgggtgacatgccggctgattaagcggtgtaccacggatttttaacctattgccatttcttttcttgtatgctacaatataaaatcagtaaatgatggaaatacttaagggcatacctttatgagcagggcaggctccacccggtaagaccggttggactctgcccaaaaagtatgggcggcagtaaggaaacaccctgcaggtatccctttacacccggtacacccgataatgcggggtgcgctgaagcgaggcgagtcatgttcaaagagcttgggtgaaaataaggaaagagcggtggcaggaacgatggagcaggatggagacaatgtggtgctttgcggtgccaattcctatgagcagaaatattattttaaccagcagttttcaagcctcccggaaagcattaagcaggagcttcagatcatgtgtgtgctttataccgaagatgtgggaggaatccttgttttggaatacgatgaggagggcactctggaatttaaggtgacggcagaagaaggagattacctgtttgatgagatcggaagcgtgctgaagatcaaacagtaccggaaggagaaacgggaacttttggaagccctggaaatgtattaccgggtgttttatctgggagaagaattggaaggcggagaataagatacgtgaagcttagaattggaaatgtgacgttggacaacaacctgatactggcaccgatggcaggggttacagacctgccatttcgttttctctgcagggaacagggctgcggcatggcagtgacggaaatggtcagtgccaaggcggttttatataaaaacagaaacacaaaagaactgctgaaagtagctgatggagaaggccctgtaagcctccagctatttggctctgacccggagatcctggcagatattgcggcccaggtggaagagggaccttatgcgttcattgacgtaaacatgggctgtcctatgcccaagatcgtaaataacggagaagggtcagcacttatgaaggatatcaggcttgcagagcgcattttgacagccatggtaaaggctgttaaaaagcctgtgaccgtaaaattcagaaagggttttacagaagaggactgcaatgccgtggagttcgctaaaatggcggaaggctgcggagtggcagcagtagctgttcacggaagaaccagggaacagtattattcaggaacagcggactggaatattataaggaaggtaaaggaagctgtggagattccggtcattggaaacggcgatgtatttaagccggaggatgccagggatcttatggataaaacaggctgtgacggggtgatgatcgccaggggagccaagggaaatccctggatcttttcaaggacccttcactatctggaaacaggagagctgcttcctggacctaccagagaggagatatctaagatgatcatccgccacggaacccttgaaatggagcacaaaggagagtctgtggccatgcgcgagatgcgcgggcacatggcatggtacactgccggcctgccccattccgcaaagctaagaaacgatatcaaccaggtgggaaccatggatgaattgagaaaatttgcggaagaaaggatcggaaaaatccggtcagataaatggaatcaggagtagttgtattcttgacattttcagatgtttacgctataatatttggaatgcgaatgagcgagtatgaaaccaggaggaatcaaaaaccatggtagacaagaaaaatattttaacctacgaaggccttaaaagatacgaggatgagcttcagaatttaaaagtagtgaaacgaaaagaggtcgcccagaagatcaaggaagccagagaacagggcgatttatccgagaacgctgaatatgatgctgcaaaggatgagcagagggatattgagctgcgtatcgaagagctggagaagctcctgaagaatgcagaggtcgtggtagaggatgagattgatttagataagattaacattggctgcaaggtaaaagtctacgatgttgacgaggacgaagagatggaattcaaaattgtgggttccacggaggcaaacagccttcaaaataaaatttccaacgaatccccggtaggtcatgccctcatcggcaagaaagtgggagatgtggtagacgtagagacacagtccggagtgatccagtataaggtattggaaatccagagagtgtcttaggtattttttgggcaaagctgagtgcagcaatggctgaacttggaaaattagccgttcgatgagccgaccggcgaatcggacttctttaacatagttcacaaaggagtgaaaacaggtggcagaacagcagaatcaaaaccagaatcaggttatggaagaagacataaaccatttgctgaaggtccgccgggaaaagctggcagagcttcaggagacgggaaaggatccgtttaaagttacaaagtacgatgtaaccgtacacagcagtgaaatcaaggaacaatatgacgaatgggaaggaaaggaagtatccattgcaggacgtcttatgtcaaagcgtgtgatggggaaagcttccttctgtaatgtacaggatttaaagggcaatattcagtcctacgttgccagagacagtatcggagaagaggaatacaaggaatttaagaagctggatatcggtgatatcgtaggcattaagggaattgcgtttacaacgaagactggagaaatttccatccatgctgagagtgttcaactgcttactaagagtcttcagattctgccggagaagttccacggtctgaccaatacggatattcgttacaggcagagatatgtagatttaatcatgaatcccgaggtaagggatacttttgtaaagcgttcccagatcatcaagtccatccgtgactatttagatgcccagggcttcatggaggtggagacgccaatgctggttgccaatgcaggcggcgctgcggcaagaccgtttgaaacccactacaacgcccttgatgaggatgtaaagctgcgcatttcacttgagctttatttaaagagactgatcgtaggcggtttggaaagggtttatgaaatcggacgcgttttccgcaacgagggtgtggatacccgccataatccggagtttactttgatggaattatatcaggcttataccgattaccatggcatgatggaccttgtggagaatttattccgttctgtggctcttaaggttcttggaacagccgtggtgacctatgacggcgtggaaattgacttgtcaaaaccatttgagcgcataaccatggtagacgctttgaagaaatacaagggcattgattttactgccgttcatacggatgaggaagccaaagctctggcagaccagtaccatgtggaatatgaggcacaccataagaagggcgatattttaagcctgctctttgaggaatttgtagaagagcatttggttcagcctacctttatcattgaccacccggtggagatctcccctcttaccaagaaaaagcccgatgacccggattatacggagcgttttgagctgttcattacaaagcgggagatggccaatgcttactctgagttaaatgatccattggatcagattgaacgctttaaggcacaggaagcactgcttgcggcaggtaatgatgaagccaataccatggatgatgattttgtaaatgcactcatgatcggtatgcctccgactggcggtattggaatcggaatcgacaggtttgttatgctgcttacggattcttatgcgataagggatgtgttgttgtttccgacgatgaagagcaaggatgtttaaaaagtcttagaacccttgattttacgaggttctattaacatgagaattattaaaattaatgatttgacaccagtttgacaccaaattaataagatttgacaccaattatacaagagccttggtatgatataaaacataaacttaatatattttggacatctgaataagtctataagcttgtagaaatatgagtctataggcttattttagtgcctaaaagtatcatgtgaggaaaaatctgtacctgtgccagtaaacgtcaatatgagttttctggtgcgttacatgggtactatagctgcatcgcaatagccggacttgaaatagtagttttatagcagtcaatatgtgtaactacctgtaaacattgtagcggttttctaaagagtatttatgatagtaaatacgatatgttctttcttattatataggttatatattatttcagttcagtaagtgaggaaaaagtgccgtctttgatgggagttaagtttggaaagtgaggaaccccctccgttgccgaactctcgcagaaaatattaaggaaacataataagcgaaagaggtaaagcaatggtaaactttagtaaactgatgaataaattggaaaagaaaggcatcacaacatatacgattagaaaaaagtctttgatttcccagagtagggtagattgggtcatttaaggtaaggctttctttatcatatcctttagatgattgggaatgtcatatgtttttatatgtacaaagctaataaatgttttattcccagatgaatctatctgaaatgatgcttcgtcataaccaactggatcatgcgcccctatcattggagtaataccaaaagtaatatttatatttccatgttcctttaagatcttttgaacttttatttcataattaaaaatagctggggtcattgtaaaatattcgtcatagaagccatttgaggcggatgtaatatactcaataaataatgctattattaattcatcctttaactcagtgggggaagtggcattaatattaaatgtgctttgaattttataattgttgataaaattggcagatatcaataataataagaaccataataaagccaagtatacaattaaattcttccgatttttcataatttcccccattgagaattgcttaattaataaaagatattatttctaaaagaaacttattccaaagagcttgttaattaaattgagattgggaggtcaagatggcagaaataaaagttgaaatagggcacggtattgatggttatgagtgccctgagtacgaaaacgatgaaactgagcttggtcagagcttttgccaagaatgcggtgaaccgcttgaatggaaagaggaatataattaggaaaaggtatggaatgaatatcaacagacccacataccttctttgggcagttgtttggtcttttgataaagggatatgattttattaatcgttattagggcgaatatatcgaaattctcaaagttaaattcggcataataacagggcgtaacctgaattatttgattttcaattgcatctgcaatcgtattacggtcattgaaaagatgcaagggaatttgaattcttccgtcaagagagttaaagatatcctcatcatatgaaaagctgaagtttgaaccaccataggcataatatgcaatatcattttctgtatttagtaacctgtatttggcatggattcctctgctcatatggatacctcctcaaatgatgttgaataattgtaatcattactataataatacaattcataaatgttctgccgagttttgctgcatttattatagcaaatttatctggaatggcaagaaaaagtatatgagagtgagaatattaggattttacgaatctctgtacattgaaagcttaatattgatggtcagtaagttggatagtatactattcataaaaatgaaatatctatatgacgtgagttatgattttttagtttggacagcatcaggtagatattgatgtagataaaacgagatcattctatgaaaatgctccttttattagtgaaggttgttcttgtagtggttgccgtaattatgaaaaagttattaaagcgcttccaccagaagtgacagttttttttgatctgggagttgatatgagaaaagtaagtgaagtttatgtgaattgcaccaattctaacgggacattgttttacggtggtttttatcatctttgtggaaccttgttggcgggcaaaagtgcatgggtgcctaagagtccttcaacttctcattgagaagaagaacaagcgtttcgagtaacagatgattttcatatttcctttcaaagagaatgtgatttgctggaggatgttttcctagacccgctttgcagttggaaatatctgcaaatgtcccctgggtattacttgaagataataaatatatgtaagtctatcggtgtaatgcatatccaataatgtactgaatatgaatagaaaaacactaactatcagtgttgagctggtagttttttattgcggtaaaaactgaaatttgacggaacacagattgaaagtgtcattgctttttacgtagaatgcactccataacttttggagtgcaaaatgagatgagtcaatgaggtattaattaaaccctgccaacattaaaataccaattaggtataacatcttttttagcaggaatcgctctgtaacctgctttaaccatggcttccataaagcattgtgaagtaatttggtgcccaatattaaccccagtaaagcggttgaagcacgccttcagaccataagcagtctgttgatagttaatgcttggaatcatcttatagttaaaaaagatgtgatcgatcaaaatatactgatcctgaagagatagatcagaaaaatgattaacttttatcatggaacgtctcctttggtctattctcggttctggcgtgagcctacaaataaattatatgagaaatgtaaaaagatatgtcaaataattgaaaaagctgtaattataagagtaagatagaggtatatcatgggagctatagcattattaggattacttgtagggataattttatgggcaaaagaaagcacgacaccaaacacaccggctgagaacacaagagatttagatggaattatgagagattccaataaatattcataaaaggaaatgcaaaatagaatacgaaacggacactacaaataatatgagcgtcatatatcgttgaaggctactaaatgctaaagatctggtggcttttgtattgccaaaatagtataatggaggtgttgatatgaataagataaaagtagaaacttttacaggtggcaagaatttagtacaatacacaaaaggagaatctgaatataccgtttcttggggagaaacaaactttgaggtttcttatgcagcttttaatgatattctcaacaatttacttgtgagatcagatacatggtatccgcttggtgcgagcatgacaaaacctacgcatggaggactgggcgaatatacatctaataatattaagaatttaactcctcgacatgcttcagcaatagcacccatcatggaaaatgaaggatttcttgaacatagaattaaaggaagtgcgatattactaaagaaaattactgataaaatttgagtttgatggggtggtaacatgaaagtaaaagtaaagaattttttaatcagtggaattgtaatttcagaattgaagataaaacgaatcagtatattgtgattgcagagagctgctaacaaatgaattaagtgaaaaggatattgttgaaattaaacttgaaagaagtatgtggatgggtgaatagaaagaggtcgtcataacaatttaataaaatctaagattcatggaaaaaatagtgggattaatggatatatcaaaaaaactgctggaacttgtaagtattgatataactgcaaccgccggagaagatgaggtttaaattgattttggaggagataatgaagttgaaaaataaggcgggtgtgaatgaaaataattcttaaaagctatatagataaagtagaagagtcgattgcagactttgataattgcgaaaagcttcgtaaagaagcaaaaaaatttaattcgttatttagataatttgaagcgggaaggctggattgatgtcccatggagggtgacgtaatgtctcctgattattccacattattcattgcttcccggactccatatgagggacagtttctacaatttaaagaaaataaaagagtataattttattataagaaaatttgttgataagggagattttattgtgtggaattattgccggtaaatgaagattataagcaaaatttagtttaatagaaatagcttataaattgttctaaattatataaataaacatataattagattgttaacaaatataaaaaagggagagtttatttatgagaaaaagaaaagtattgtgtggcgttttattgtcagttaccatggcgctaggaggtgcggtgacttcttttgcagcagaaagttatagcacatatgataaggtcgaagtcgatgaaacaattgttgatacggtaattatagatattcctcaagacgtaattaataagtctgagcaggctgccaaagatcaaataatgttgaacttgaacagattgcgctcgccgtcatatgaatataaattagaaaaagtaggaactaatgtagctacaaagactaaaataggttacgccgcaaaccagcctgctaatggtactgtttttgcatcgaaaggcggattttactggtcggatggcggaaatgagactacagtatcattcagtgttggttatggtgtttttagtatgagtgttagtccggggaaaacgggtacttcaggtacgtggattcagtcgccatatgtaaatacagccgtcaaattattgatttataaagatataacagttactaaatatgataaatataggaaacctattgcagggaatggaaaatgggaatatgttggaaatgagtatgcaaaagtgccaacgagaaactatttagaagtggtaaaagtaaaataaaatgaaaacacataaaaaaatattgttcggacttcttgtttttttgattatatgtgcagttggtatttttcttaattataagaaatcattgaagggattttcagtattgcagggaacatacacatctgataaacttccattcacatcaatggtttttgatttagataataattatacattttattattataactatgatgaaacagataaaggcacttattcaaaaggctcggataatgagcactttatcaatagttccaaatttaataatactaaaatactgtataatggggaaaatcagacatttacaattgtgatagatggggaaacttacttgttcaaacagattaatcggttgccaactataaaaattgaaccagaaaagaataaagagtaataaagagaagaatattgtaatcagtcagaaggcattggagaattataatccagtgccttttatagtgcttatagtgtaaaaatatggaggtaggaaatatgtcattttcacaggaaagatatagtataggtaatagacatgatattaaagaagaaatatgtgctgacgtaatccagtacccacacttgcccggtgaagaggtttacgaatagccgattacctctatacatttttcctgcggcgtttccttcgtctgaccatcttgatgaaaaggacagaggagacgaaatttaatgaattacaagttgcgctgaatggagcataggatacctcaaatttttataatcttgcatatatttacctaataaacattgactcgaaagaacagggtatgtttcagaacataccctgttcttttcggctgtcgattcctgttaagtttcagagctccagattctctttcatgcgatctttcatgtcgaagatatgtactagattatgaggtgggtttattcagaacattaaacctataattcgttacttttatcaaccatacgacttatttctatattatacctttcttgtaaagttttgcttaagtaaggaggtgaaaagataactgactatcccattcctttatgttatggtgggaggtcatgaagtttcaaattatcacggactatgttttgagaatcattctctgcatggcacagcggaaggataaggtctcacccgtaaataaggcggcggatgcgatgggtatcatctgtccaatgcaaaattctgcagtcttttcaagaagaaaaagcgggttgactaaaaaacgacttgatgaattggatgggctgattgtccattcacaaaaaacataaagaaaaatgatctcttgatatgaggagcggcaaatgaagcggaatgcgtataaatgcagcacagcgtttttccgaatttaaaaaaaaggagcaggcgttaatgaaaatttatggaagaacccttttgaaaaagatctatatgctgttggccttggtagtagtaatgtcggctgttctgggcagtcaaatgattgcccgggcggaagcttcagttaccatgatctacacagcagaggatttagttaatgtaagcaataatttaagcggaaactatcggttggcaaatgacatcgatttgacatcctacctggcagacaaaagtaatggctgggcaagcataggcccgttcagcggaaaatttgatggagacagccataaaatcactggcttgtggcacaatagcggcggcgcctataaaggtttgttttccacggcaaacaacgccacaattcaaaatcttattgttgagcttgacgccaaaggcatttccggtgcctatgaagtcggtggcattgttggtaaggctacgggcgctacggtcatagaaaactgcactgtttccggcgggccaattaaggttaccggaggcggatatgcaggtggaatcgttggaaaatcagacgggcctgatggaaaagtgattaactgtaccgtgatgaacgtgacaacttatacaagcggaaactattccggcggaattattggcgtggcctataagacaaagatcacaggctgtaaaactgttgatgtacgtgcggagggcaactcctacgttggcggcttggccggtgctatacatggacagtctgtgatcacagacagcagtgcagcgggagggagcatttatgcaaggtcttcttatgccggcggttttatcggcgctatgtatgagcaatccacaatttcccggtgtaatgcggaatttgaaactgttagagcggctgcctcttatgccggaggttttatcggtacggcctatgaaaaagctgatatatcatattgctatgcaacggccgatgtttttgcagactatggaaactatgtcggaggctttgctggagaactgaactccgtgacagtcactaacgcttgttctacggggaatgtggcggcagtgagagggcaagtagccggcggttttgccgggattgcctatgcccagtcctcactaacccggtgcaatgcattgggagatgtatccagcaacggtaattatgccggtggtctgttaggacaattgcatgcaggctccatcaataatgcgtcaacggttgaacagtgcagcgcctatggcaacgtaactgcaaagggaaatgttgtcggtggtttgatcggtgaatctctttattccaaggtaagcaacagctatgcccggggtgacgtgtcgggtaagttaagcgttggaggtctggtaggctatttttccggaaccgcttcttctggacagactgtcctgaactcttattctaccggaacagtgtcaggcatttcagggagtgagttgggtgcctttacaggacattctggcgttacatttacaggtaccaactactatgacagcgaccgggccaatgtttctgcgagccatggctctgccggaagtccgtccgggataccgcctcaaggacgcggaacggaagagatgatgaagcaggagaccttcgttggatgggactttggaaatatttggaacatcgttgaaggtgaaacctatccgtactttgatttttgtggttttacaccagaggttcagaatgtctctagacgtcctgttatcaacattgtatacaccacggacaaacgggtatcgggtacagggattcccggatctgaggttacggtgacgtttcccagcggcgctataaatgtgactgaggtcgattcccagggcaaatggtatattgctgtacccagcggcgaatcgctttatgtgggagataccctgacagggacacaaaaggaagctggaaagttggtaagcggtccggccaataccgttgtagcagtgcggaatttgctgccgtcgattgaaaaaaattgggaaaacctaaatggcaaatcgacagtgcgccccggagataccctgctgtttaccattacaatagaaaacacagatgcgtccactcttacctggaaagatgtcgtcgcgatagatgcgctgcaccaatatgtatcctttaccgatgggacacttgagattgacggcacgccggctgatatcgggcaggggaagaacaatatatgtatgatgaggatagccattcagtgacgatatatctggggctgctggttcccggacagtctaaaaccattacttttcaggtagtggtcaacgaagaagtgccggatcaaagcgaaattaacagtggcgtgcatgtaaccggaaactattaaatagggttacggcttgcaggaggaataaaagtgagaaaaagatcaaaaagaaagccttatgagcgcattttaaatgaaaaacgggcaagagccagactgaagcatatagctcgggtcatatctgcctttaccgtttgtacggtagtaatcagcaggtcgcatctgacagtaactgcggcatatctgggaagagccccacataaaaatgcactcacccagattgaaatgatacatagtcaggattctacatatcagatcgaggaccatagcgagataacgctggaaatggatgaagaggattatgcaaactctgaagcctttgacttcgaagctggcattctttcggaaaatgaagagattgaggcggatacagatgcagtagatatggaagtgcaacgttccgcttctccaaagcttcttttcagtgaggattatgaggaagcagatagtctttaccaattcacctttgaacacgaaggtgtttccattgctacaatcatcgttaatggggaaggtgaaattgtaagtgaaacatacaatgaaaattacctgattgaacattttgatggctgggaaactacaagtataaagaatgaaaacggacgattaaacgttaccctagccttatacgataacgaaagcggttccgcgatcatttattcgcagaacgatcctattaaaataggtgaaggggatgccgatgctgatgccgatggtgatgctgactcagatgccgatgcggattctgatgcggatgccgacgctgatgccgacgctgatgctgacgcggatgccgatgctgacgcggatgccgacgcagactcagatgcagatgctgacgcagatgcggactcggatgctgacgcagattcagatgcggattcagatgctgacgctgacgcggatgcagatgcagacgccgatgcagacgcggatgcagatgccgatgcggactcagacgcggatgcagattcagatgccgacgctgatgccgactcagatgctgacgcggatgccgatgctgatgctgatgccgacgcggatgccgatgcggactcagatgcggacgccgatgcggatgccgactcagatgcggatgctgacgctgactcagatgcggattctgatgccgacgcagacgcggatgcagatgcggacgccgatgcggacgccgatgcggacgccgatgccgatgccgatgcagatgcggacgccgatgccgatgcagatgcggacgccgatgcagatgcagatgcagatgcggacgccgacgcagatgcagatgcggatgcggatgcagatgccgactcagatgctgacgccgatgctgacgctgactcagatgccgatgcagatgccgacgcagatgcagatgcagatgccgacgcagatgccgatgccgatgcggactcagacgcggatgcagatgccgatgcagatgctgacgcggatgccgacgcagactcagatgccgatgctgacgcggatgcagatgctgacgcagatgcggactcggatgcagacgcagacgcagattcagatgcggattcagatgctgacgctgacgccgatgcagacgcggatgcagatgcagacgccgatgcagacgcggatgcagatgccgatgcggatgcggatgcagattcagatgccgacgctgatgccgactcagatgctgacgcggatgccgatgctgatgctgatgccgacgcggatgccgatgcggactcagatgcggacgccgatgcggatgccgactcagatgcggatgctgacgctgactcagatgcggattctgatgccgacgcagacgcggatgccgatgcggacgccgatgcggacgccgatgccgatgccgatgcagatgcggacgccgatgcagatgcagatgcggacgccgatgcagatgcagatgcggatgcggatgcagatgccgactcagatgcagacgccgatgctgacgctgattcagatgccgatgcagatgccgacgcagatgcagatgccgatgcggacgcagatgccgatgctgatgcagatgccgactcagacgcggatgccgatgcggacgcagatgccgacgctgatgctgactcagatgcggacgccgatgcggatgctgacgcggatgcagactcagatgccgacgccgatgccgatgcggacgccgatgcggatgccgatgcggacgccgatgcagatgccgatgcggatgccgatgctgacgcggacgccgatgcggatgccgatgccgactcagatgctgatgccgatgcagatgcagactccgatgccgacgctgatgcggatgcggatgccgacgccgatgcggatgccgacgcagatgcagatgcggatgcggactcagatgccgacgccgatgcagatgctgatgccgatggtgatgctgactcagatgccgatgctgatgctgatgctgattcagatgccgatgcagacgccgacgctgatgctgacgcggatgcagatgctgacgcggatgccgacgcagacgcagatgccgatgctgacgcggattcagatgctgatgcagatgcagatgcagatgccgacgccgacgccgatgcagatgcagatgcagatgctgacgcggatgcagatagtgatgcggacgcagatgcggactcggatgctgatgcagacgcagattcagatgcggattcagatgctgatgcggatgcggacgccgattcggatgcagatagtgatgccgacgccgatgcggatgcagattcagatgcagatgctgatgctgatgctgacgcagatgcagatgcagatgcagactcagatgcagatgccgactcagatgccgatgcagatgcagacgcagacgctgacgccgatgcggactcagatgcagacgccgatgcggatgcagatgcagatgcagactcagacgcggacgcggactcagatgctgacgccgatgcggattctgatgccgacgccgatgctgacgcagatgcagatgctgatgccgatgcagatgctgacgcggatgcagactcagatgccgacgccgatgcagatgctgacgcagactccgatgccgacgcagatgctgacgcggatgcagatgcggatgccgatgcagattctgatgcggacgcagactcagatgccgatgcggactcagatgcggatgcagacgccgatgcggattcagatgcggactcagatgcagacgccgatgctgacgccgatgcagatgcggacgccgatgcagatgcggatgcagatgccgactcagatgcagatgctgatgccgatgcagatgcagatgcagactcagatgcggatgcagactcagacgcggacgccgatgccgatgcggactcagatgcagactcagactcagacgccgacgccgatgcggattctgatgccgacgcagatgcagatgccgacgcagattcagatgcggactcggatgcagatgccgatgcggactcagacgcggatgctgatgcagatgcggatgccgatgcggacgccgatgcggatgccgacgcggatgcggatgccgacgcggatgcggatgccgatgcggatgccgacgccgatgctgatgccgactcagatgcagacgcggactcagatgcagacgccgatgccgactcagatgctgatgcggatgctgatgccgactcagatgctgatgctgacgccgatgcggacgccgactcagatgcggatgcagacgccgatgcagacgccgatgctgatgcagactcagatgcagacgccgatgcggattctgatgcagacgcggatgcggatgccgactcagatgctgatgcggacgcagatgcagacgcagactcagatgccgatgcggactcggatgcggacgctgactcagatgctgatgctgatgcggacgccgattcagatgctgactcagacgctgatgcggacgcagacgccgatgctgattcagatgcggatgccgatgcagacgcagatgcagatgcggattcagatgcagacgccgattcagatgcggattcagatgcggacgctgactcagacgcggacgccgatgccgactcagatgctgacgcggatgcggatgccgactcagatgctgatgctgatgcggatgccgactcagatgctgatgctgatgccgatgcagactcagatgctgatgcggattcagatgccgacgccgatgccgatgcggactcagatgctgactccgactcagacggcggttccagcaactccggcggttccagcaactccggcggttccagcagctccggtggtcccggcggctccggtagttctggaagttccggcggtccaggtatagaggttgtagaagtgctgccagatgataatgtaccaatgggagttatcgatccggaatataccacagagtctgttataggagttccgggagaaagagtgccgacagcttcaggagcgtgggattctatgcctaagaccggttataacaaaagtgatttgcccagagatggctttttggctctgctttcctctatagggcttggcctgggattgggaaaaaagaaacgtagaacggatataaagtgatcttcaaataatgtcacttgttccggaccatccatgtcgataatattataagtgtgctgacttgataaaggttgacgagataaagctcattggcctttatcaagccttttatgaaagcatggaaagttgagaaacaatggggagataaaatgaacggttcaaacgaaactgctgatataaaaatggtaaaagaaaaaatgctcatgtttcagaataagctggaggagctttctgtaagcgaacggaacgggaaagtaaaatgctttatatccgtcggctatcagtcagaaagagctgttgtctttacgggaattggaaacagcaaaaatactgcgttcaagatggcccaggatagggcagtaaaacatattaaatcaaaaaaccagaatccgccttggctaaaagcggattttgtggtaatggaaaaacggctgaccagatttgaatttctggaacttgcctcaaccataaaaagatattattttaaatacggtatagcctttgatgaactgtataatattgcttttttgcatcaggaagtgaacggagcatgtctgctgaaatatacagagcaggaaagaaataaaccaaagccaagtacggatacgttggagcttgccggaatttctgttgatacggactcgacaaaagcaatagcggaaattaattggggaaatgttaatcattatttaaagtcagttcgtggacagtcccttgtgttaggagactctgtcctgaatgatgtggttatttttgaaacaaagagctatttttatgatgaggaagaattttttgaactggaggaagccgagctgagcaccgccaggagaaaaatctccgtgttgtcaccggaaatcctgaaagacctgctgtttaaaagctccaggtatttggcaaatacggtacaggacaacggccggttcatttatggctattttagctgctttaataagaagatctcatcctataacgtggtgcggcacgcattaagcgtctattctctggcggaaacatacctggtaacaaaggatgagacactgctggagcctatcaggaaatcctttgcttatctcatggggaagtatatttacacggttaacgactgcgcattcgtcgtagaatttgataacaacgatgagatcaagctgggtggactgggtgtgaccgtgctggccattgtcaaatatcttgaaattttcaatgagaaaaatgaatatttacaaatactcagacaaattggcaacggcatacgctatatgcaggacgaagaaaccggacagtttacccatgtgatccgttttccaggtcttgaagtagccgaccgatttcgaatcgtttattattccggagaagccgcctttgccctgatgcggatatattcgatagaccgaaatgaattatggctgaattcggtaaaaaaagcattcgagtacttctttgcccatgactattggcgcaattatgaccactggcttgcctattgcaccaatgaattgaccgccgttctgcctgaagaccggtattttatatttggattaaaaaatgctttcaacaatctggactttatgatgaaccgaattactacctgggcgacttttcttgaactgctctccgctgcggatgccatggtcaggaacataaaagcctgcggcaaagaccatttgctggaaggctatgatatcagcaagtttaaaacggtgctgcaaataagggcgaaccggcagttggatgggatcttctttccggagcatgccatgtattttaaatcacctgagaccattttgtacggtgcttttatcaggcatcatatattcagggtaagaaatgatgacgtggcccatcatttatctggttattgtcactatttaacggatatcgtattgtcaggtaactgatagaggggagtagaaaatgaggggaagcggctccttctcaattctccgtttccggcataaagacatagcatgggcctaataccattttagtataactgcaaaacacggtaaacccaaaaaagggacattttcactcagattgaaaatgttccttttttagtccacattcagcaagtgaaaagcagaaggatgtaggaaggggatagaaaagaagttgaaagaccggagagtatcagacgaatataaaaccctgaaagcatcagggagtgaaagggacaagctttcctcggattcaatgggtgagagagcagacaaaatagaaagaaccttgcagaaacatatctgaatggcccgcttagcttctgaatgataaagccggtatcacgccattttttcagctgtgttatgcggcctaaggttttggaaattgtcaatgatgatacatcaatgagtggatatgaatttccaaagggagatgtcatgtcagtgaaaatacaccctgattgctgcacgcaccatgaacatgcggaaaatacctgacaattcccatgcattaatccatatgacatccaatccattgaaagagaaaaatccataaaatccccttggctgtgtttgaaaatcttgacaattccaaaacctgttatttcgtttatttatttagaaggaagtatatgaattatttaaatgtaattatgacgacttccttgatagtcacttaaaatctattcctggcaggagcacactgtctcatgctcttccagagcggtctggtagaatttgttaattggggttgtgatgctgccttgaaggatgccgtctatggacaggatgctgtcgtatccgatctgatacaatggctgctgaatgctggtgatccgcggaccccggtaggaaaagccgtatgtattcagattgtcaaagccaacaacagaaacatcttcaggcactttaaaaccagactgctgcaattcgttaattaccaccatggcaatcttgtcattgctgcagaagatggcagtaggccgctcaccagccggatgagccatcatctccctgaaattgggaagggagagtgtggagtcattgagagtattctggatataatggtcctggatcagcagtccgttgtcctgcatggtctccatatagccgctgaaacgctccagaatgactttcttgttaggattgcccatcacatgggcaatgcgtctgtgattgtggcggattaaatagttcacggcatccttggcgccggtcacgttgtcaataaggaactggttgacaggcatcatctggaagttattttcaattaacagaaaaggaaacccaacttcctgcagatgttcaatcattgctttatcggaaaaaagagagccatacaggatgatggcatcggaaatgccatttgtcagatattcgatgtagcgatccctgactttttcgtcttttcccggactgcaaaatatgacattacgtccaaggagagcggaggcatcctcaattccacgaatcagatcggtgaaaaaggggtcatgtatattacgcagaagaatggcaatggaatctgtttgtttctttaccagtgaacgggcagcgttattaggaaaatatcccaattcttttatggcttgattaaccttgtctttggtcttgggcgagactttatcagagccattaactactcgggatacagtggttaaggaaactccggagtaagctgccacatcttttattgttttcatttttaatcccttcttatgaaaatatttatgctattttcattatagcatatctaaaaatcactttcaaggcagtatagtggctaaaaatgaaaacgtttataaaaataaaatggtaaatacttattaaaaaaacaatatattataaaaaaacacttgcaaaatgcacaattttttgctagtatgtagttgtatcaagaatgaaaacgttaacaaaatagtaagagggttaaaaaagagcgaggaggaaaaacatgaaaagggtagttaagagaacattaagtatgactatggcagctgcttgtgtcttggggcttatggccggatgctctccggccaagggagaaaagaaggcggagagtacggcaccccagtctgaccagaagaaagaagcttcgggggaaccggttaccattaaattttgggatggcaactggcaggaagctgtttggccggaggtagaggctttatggaacaaggaacaccctgacattaagatcgaagcagaattccaggcggacctggcaaatgataaatatatgctggcgctgaaaaacggcactgcaccggatgtcctgtcttgtgcactggactgggttactacattcggcaatgcaggtttgctggcaccattggatgagtacgtggcaaaggattccctggatgtgagtcagtttgtcaaaggtgcaaacgatgcctccactgtgggcggaaagctctatggcctgccattccgcagtgagacctatgtcatgttttataacaaggacattttggcggcagcaggatatgacgcaccccctgcaacctgggatgaggtcaaagaggtggcagctgcatgtaccggcagcgacgtgtacggatatggtctctgcggcacaaactattcgaatttttcattccagtacataaccatgctccgttcttccggcggtgatattttaaatactgacaacagcgcatctgcttttggaagtgatgtggcaattcagacggcacagctctacaaggatctggcagcttatgcacctgcatctttgctggagaatgacaacattgcaaaccgcaccctgtttgccagcggcaagattgcaatgtacttaagcggcatttatgatttagcggaaattgttaaagcaaatcctgatctgaattttgcctgtgtcatggttcccactgcaaacggtgcggagaggaacaccattttaggaggctggtccgtagcggttgcagagagcagcaaggagaaagaagctgcatgggaatttgtgaaattccttagcagaccggatattgcagctatttatacaaatacttttacaggtacggcagaagtagcggcccgttacaccgactatccggaagaaatcatcaagccaaatgcagatgccctgcagtatgcaaatgcacttccctccgttgaaaacattgtaggcatccgtcaggccatcatggataaccttcagctgatgctgtctgaggacatgtccgctgaagaagcatgcggccagctggaccaggcagcaaataaattattagagtaatccgaagaggggcagacaggctccgctcacaggcggggccttcttttaaccgaatcaagtaagcccggtgaagcggggcagagcctcccccgcactatcggggacgctatgagcaaatagggtcgcggagtgcgaatatccgcttgataaagagaaaggtgaaagtatgcttagaaaaatcaaacgttcaggggccggctatgtacttcccgctgtgatcaccgttgcagttgtcatgatatatccgctgctttatacgttagtcatgggattctttaacaataccctgttcctggaagcacctgttttcagcggcatttcccagtataaaaagttgtttgaggataaggtgttcctgggttctgttaaaaatacattagtatggacctttggaagtgttttcttccaatttggtctgggttttatcatggctttgatacttcaccagccatttgtgaaaggaaagacatttattcgaatcctgctgatgatcccatgggtaacacccagcatcatcggttccgctgtatggaagtggatgtacaatgctgactacggtattattaatttcattttcagcactctgggaattattgaaaagaaccagacatggctgtccaatcccaagatcgccatgtggtctgtcattgcagtcaacacatggaagatgtttccgtttatcctgctgatgattgaggcatccctacaaagtgtgtccaaggatttaaaagaagctgcagtgattgacggagcaaatgtatttggcatctttaaaaacgtgacatggccttccattgccgcgacctgctattctacgatccttttaatgatcatctggaccctgaatgcatttacctttatttatgcaatgacagagggcggaccagcccataagacggaagtaatggccatgtacatttataaacgggcatttatggattatgatttcggtatcgccagcgctgccagtgcagtcttatttgcgttatcgatgttcgtaagtcttgtatatctctatcttacaagagaaaaggaggggaagtaacatggtgaaaatgaagaaatctgtaacaaggactaatattgtctggcagatttgtacctatgggatcttacttcttgtagttatggcagcagtgtttccggcaatctggatgctgtctacatccatcaagcttcctactgaacagtttgatattcctccccagatcatcccggacacaccaacgttcggtaattatgttaatgtacttacgaattccaagatgtttgatgcttttgttaacagtgtcatcattacagtcagtgtggtagctgttacattgctcatttctatcctggcaggctacggtttaagcaggtataagttcaggggacatggggtgctgaagattgcacttttgttcgggcagatgattcccagtgtggtaatcattatccctttgtattttctgattgcaaaaacaggtcttttggatacccatttttcactgatcatggcagatatggcactgacgattcccatgggtgttatcatgctcagttccttttttgagactgttccaaaggaattggaggaagcggccaaaattgacggctgtacgggaatcggggcactgtttaaggtggttctgcccattgcaaagccgggactgatttccgtggctatctacacctacatccatgcatgggaggaattcctttttgcgctgaatttaagtacatcgactaagacaagaacacttcccattgctattcacatgtttgcaggagagtttgcagtagactggggctccaccatggccgcatcggccgttgtagcttttccggtactccttatttttctttcatgtaacaggtattttgtcaagggtatggcagacggtgcggtaaaaggttaacaaaagccggcaggcagcaggtgaatcagcaggaaacagtgaataggagtcagaatggacaggaggcagacaatggatattaagagcagtcagacggaattaaattatgaggagtgtctgaattttgtgaggcagagctccaatccgtctaaactattgatcacggatgtaaaatacaccaaggtggatcttcctccatgggggtgttatctggtgagaattgataccaaccagggaatcagcgggtacggggaaatgcgtgacggcgccagcgccacctatttaaaatatttaaagagcaggatcattggtgagaacccctgtgaggtagatcgtatttttcgaaagatcaagcaattcggcggccagtccaggcagtctgccggggtgtgtgccattgaactggctctttgggatctggttggaaaggcctacggggttcctgtgtaccagcttttgggaggaagattccgggataaggtcaggctctatgcagatacccatattgaggaaggaagggccaccggcattttaatggaaccggaaagagtggggcagattctgaagggatacatggatcagggatttacagcagtgaaaattctcagtgtggagcttctcatggcgcaggaagggaattacagcggtcccttagactgggtcaatgagctgcgggccgtggaagaagaagtacgcaaggtttcaaggtccggcaccagggctgaagtatccgcggccaatgcggccctgtatgattttaaccgggtttcccatccctttaccaatatgcatgtgacggaacagggtctggcacatctggatgaatacatcggaagggtgcgggaggtgatcggtgcgaaagtgccgttagccattgaccatttcgggcattttcctcttccggatatgattaagattgcaagaaggcttgaaaaatataacctggcatggctggaggatatgctcccctggtatctgacggaacagtacaaggaattaaagcacgccacgacagctccccttgcaacgggagaggatatgtacttaacggagacctttgaaccgctttttgaggcaggcgccctggatgtggtgcatccggatctcctgacttccggcggaatcctggagactaagaagcttggtgacagggcagccagatacggggtgtctatggcactccatatgtgcgagagccctatatcagccctggccggagctcatatggccactgccagcgagaatttctttgtacaggaacatgacgcctttgattctgagtggtggcaggatctgattatagggccggtgaagcctattgtacagaatggctttacgtcagtgactgatgcacctggtcttggaattgagtcccttaacgaggagctgatccgggagcatggtcctatgaagggcaaaaatgtgtgggtatctaccgatgaatggaaccaggagacttctctggaccggatatggagctgacaggatatgatgagattagcatatggacagattcggagcgtggataaggagatcctcaccaatgccaggcagatgggcattgacagggtacagtttaacctcccgtatgatctgcctgccaaagagttttggaaatacgatgatctggctcgttttaaagaagaatgcgacaggtacggcgtgatcgtggaggcgatggagaatatgcccatttctttttatgacaaggccatgctgggtctggaaggaagagatcagcagattgagaatgtctgcgaatccatccgcagtctgggccgtgtggggattcctgtgctgggataccatttttcaccttcctttgtctggagaacggaaaatcacgctccagcaggaaggtatggcgctgctgtacaggcttttgacttagataaacagaaacagggcattgatgatatggcggattttggtcagagaagagatgttatggtgcctgatgtggaatcgctgtgggagaattttgaatattttatgaaacgcatcatacctgtggctgaggaatatcatgtgaccatggcacttcatccggatgaccctcccatagaaagcctgtcggggattgctaggatgtttgttgatgtggacagctataaacgggcggaagctatgattaacagccctaactgggggcttttgttctgcatcggaaccttttcacagatgaaaggcggggctaagaacatttttgatgccattgattattttggacccaggaaaaaacttatttatgcccatatgagggatgtacagggtacggtgcctaaattccaggaatgctttctgggggaagggaatttcgatcccttccaggtgatatatgcactgatgcattcaggctttgatggctttatggtcagcgaccatgtgcctggcattgagggcgatcgggattggggccacaaggtacgctatgcggatactgcttacataaaaggactgatggaagctatagagaaaatgggcactatggaaaagtgcatcaatggaaaggaagagaaagattatggaaagaccgattgaggatatgagactggcacagattggatttctggtaaatgatattgaaaagacaaaaaaggagtttgcgcgtttctttggagttgaggagcctgaaaccgtaaacagcggtgaattcgagattacaaagacagaatacaggggagaaccggcgccaaaggcaaagtgctatatgacctttttttatttcggagatttacagatggagctgatccagccaaatgaagagccaagcatctggaaggagcatttagaacagttcggtgagggaatccaccatatttctttcaatataaaaggcatgcaaaagacaatcagcgcctgtgaggattggggaatgaaactgctgcaaaaaggtgagtacaggagaggaaatggaagatatgcatttatggatgctctggacagcctgaaagtagtaatagaactgttggagcgcgacgaataagagggaggatggaatcatggaaaagaggcatttccctgaaggttttgcctggggagcagctactgcatcataccagatcgaaggcgcctgggacgaggatggaagaggagaaaccatatgggacaggtattgttcggttcccggcaatgttttaaatggagatgatggaaaaattgcatgtgaccactatcacaggtacaaagaggatgtggctttgatgaagaaaatggggatcaaggcttaccggttttccattgcatggtccaggacccttccaaaaggatacggggaagtcaatgaaaagggacttgaattctacagccgccttattgacgagcttcttgatgcgggaattgaaccgtatatcaccttataccactgggacctccccaggctctccaggacataggcggctgggccaatcctcagatgccggaatatttcctggaatatgcaaagattattatagatgcatttcatggcaaggtgaagaaatggatcacattaaatgaaccttactgcgctgcctttctaggcaattctgagggacgccaggctcccggcatccgggatttctcaactgcggtgcgggtgtcttactatctttatgtgggtcatggtctggctgtggattatttccgtaaaaagggctgtgacggagaaatcggaattaccttaaaccttatgggaaggcttccccttacggataaaccagaggatattcaggcagcagccagagcagatgggtatttaaaccgctggtttgcagaaccaattgtgtacggcagatatcctcaggaaatgatcgggttttaccgttccaaaggggtccgtcttccggagtttagggaggagcacatgaagctcatcggacagaagctggatttcattggtctgaattattacaatgactttcatgtaaaggcagatgacagcgtgtggccccttggctttaggatacaaaatccaaaatacgttcccgtcaatgacaggaactggccggtgacagagcaaggtctggtgaatatgcttttgcggatgaagaatgaatacggaattgataagatttacattacggaaaacggcacttcctttccggatgtggtttccatggaaggaaaggtggaagacggcggaaggaaggattatcttcacaggcatttaacagcactttggaaggccatttcccagggagttaatgtccagggatatttccagtggtctttgtatgataactttgagtggtcattcggatatggcagccgtttcggaatcgtatttgtggacttcaatacccaggagagaattatcaaggaaagcggacactggtattccagggtgattgaacagaatggggtataaggaggccttcgcatgaaaggaataaagaaagtaaagacagcggtaatcggatgcggagcaatcagccggatctatattgaaaatatggcaaagacctttgaaattctggaattgacaggagtctgcgatttaaatcgccggttggcggaagaaacagccgatgcttacggtatacgggccatgtccatggaagagatcctggaggatggtgaaatagaaatcgtggtgaacttaaccaatcctgccgctcattatgaggtcataaagaaccttttggaccatgggaagcacgtgtatacggaaaaggtgctggcagctgatattgaccaggcaagagagctgacagccctggctgctgagaagggaaagctgctttgcagcgcaccggacacatttctgggggcagctgtgcagactgctaagtatctggtagaatcgggtttaattgggaccgtgacctccagtgtggctgttttgcagagggatgcccgccttttggctgagaaatttccctacacggccaaatcaggaggcggaattgggattgatgtgggaatttattataccactgccatgattaatgtgctgggagaggtgaaagaagtgtgcgggatgtccggagtttccatggcggagcagaagcactactttgtgaaaaatgataatttcggagaaacctatttccaggaatcagagacatatcttatgagtaccatgcgctttaaaagcggctgtatgggaactcttcactttaattccagaagcatccgcacagagaaaccttatgtggcgttctatggcacggagggcatcattttcctggaggatcccaacttcttcggaggtgaggtgagggtgatattaaaaggcaggacagagcctgtcgtattcccgcatactcatgggtacgacggcaacgacagaggtcttggagtggcagagatggcctgggccttaagggaaggacgtatacccagaacaaacggtgatatggctcttcatgcattggagatccttacgggaaccattgaaagcggagaaacaaaaaccttttatgagatgaaatccggatttgagaggcagcctatgctgccgaggggatatctgggcgggaattatgcacagaatcagcctgagggtgggctgtgtttttagattgatgaattgttaaatgaaccaggacaagaaagctgctgaatatggaggaaactctgtacttcagcagctttttaatggattattttggcaggaaatgactttgtaagggagtgcagcatatttgctgcggtgtcggaaataagatgatatatgttgacatcgtgtgtaactggaattagtatatactatatgtggtatcagaaaaagaggaaaatctcatcgagcctgaaaaaaaggcaagcggtatgaatagagaattgagcatctgatgtcagatttagattgagaaaggaaaacgatgcagagataaaattcagcagatactggatcaatggaaagcggaccaatgacagatgatcaggagaggttattctctgtttttgaaatcataagctttgttcttaaaaagaagagtgataaaatgcaaagcctggcatgatcatgatgtgacataagctgtcataacctgtaggtgggaaaggccgcctgatcacatggactggaatttattccaattagtttgatagaacagatttcagtgaggaaaggggaagaaaaagtatggataaaccataggatttgatcacttcagacgagtgcatggactgtttttccggcaggagggatctatgttattgatccgctgttggaataacaggtaaggcaatacataagtatcgcgtatattaaaagaataaaaggagaaagagtatgttaaagctgttattaagcattgccccagtcattatttttgccattataatattaggaatccttgcttccggttatgtaaaggctccgccggatactgcatacatcatttccggcttaaagaagaaaacaaaaatattaattggccgggcaggaattaaaattccttttttagaaagacttgataagctgaatctaaaattgatacctcttgacatcagaacaaaagatccggtgccaacacaggattgtattaacatttttgtggatgcagccgtaaacgttaagatcaaggcagaggatgaatcaatcgatcttgccgcacagaatttcttgaataagagttcagaggaaatcggcgcaatcgtatcagaagttctggaaggtaatgttcgtgagattatctgtaccatgaaattacgtgagttaattggtgacaggaaaactttcgtaagtaaggtttctgaaaatgtaatccctgatctggaaaagatggggattgagctggtaagctttaatgttcagaatttccgtgatgaaaatgacgttatcaataacctgggtattgataatatttcacaaattaaaaaggatgcggccattgcaaaagcaaatgcaaataaagaggttgccatcgcacagtcctcggctgacagagaggcaaacgatgcaagagtaaatgctgagtcggaaattgcaataaggaataatgaacttgaaattaaaaaagctgaattacagcaggtttcggatgcaaagagagcacaggcagacgctgcatatgaaatccagaaacaagagcagcaaaagacaattcaggctgctaccgtcaatgctcagattgccaaggcagaaagagaagccgagctgaaaaacaaggaagttgcagttatgcagcagactttggaagctgagatcaataaaaaagcagatgcagagcgctatgcgattgaacaaaaggctgcggctgatttagcaagaagacagagagaagccgaagctaagaaatatgaacaggaaaaagaagctgaagcaaaaaaggctcaggcagaagcacaaaagtattccatgcttcaggaagcagaaggtatcaaggcaaagggggaagcagaagcggccgcaattcaggcaaagggtatagccgaagcagaagcaatggaaaagaaagcggaagcttaccaaaagtacaataagattgccatggcggaaatgatgatcaaggttctccctgaaattgccgggaagattgcagaacctttgtcccagattgacaagattaccattattggcggaggaaatggagacgggggcaacggtatcagctctgtagcgggaaatgtgcccgttgttatggctaagttatttgaatcaatgaaagaagcgacaggggttgacttgtcggagatcatgagagcagaaacttatgatgcaaaagtaacgaagaacttaaatatcactggaattccagacaatgtgaaaacaacagatgcagcaaatgcaatattggcgacagaagtcgaggcagaggtgagaacagagaaagaacagacagacgagtctatttaatcgaaacaagttgcgaagcggattgcgaatatccgcttggcttcaagcctgttcaccggataaggggcaatgttatagaaaccgcactttccaatgctatacttgcactgcgtctgacagatcatattgcaaatgttattgacatttgattcttgtctctatgatatattacaaacagatggaagttgtgaagggattgaaaggagatataatatgtctggattatgcaatgaaaagcttatttatggaaatttagtcaatggacagtgggtggaatcagcatcgggcaatgtcattaccgtgacctctcctgtggacggctcttttatcggtgggatacaggcaatcagcaaagaagaagtcagtgaggttatccgccattcgaaggaaggccttcctttgtgggccagtgttcccatatatgaaaaggcacggatactgtacaaggcggcagagcttttggaggaaagagcagaagagatatcagatattctgatgatggagattgcaaaggataaaaaatcttccttatcagaagtaaagagaactgcggattttcttcggtttactgctgatgctggaaaaagcctggaaggaaccgcagtgagcggggaaaatttcccaggaggctcccgcaataaaatgtcctatgtaaaaagaatccctcttggtaccgttttagccatatcgccctttaattaccccatcaatttatcggcttccaagatagcaccggctttgatcgggggcaatacggtcatattaaaaccggcgacacagggagccatcagcgctcttcaccttgtaaaggcgttacaggatgccgggttgccggatggggtactgcagagcgttacgggtaaaggcagtgagatcggtgattatatcgtaacacatgaaggcattgattttattaatttcacgggcagtacggaagttggcaggcatttatccaaaatatcctgtatgaccccactgttactggagcttggcggcaaggatgcggctcttgtgctggaagatgctgatctggaatatgcggcaaataatattatggaaggtgcattttcttattccggacagcgttgtacggcagtgaagcgtattattaccacagataaagtcgcggaccggttagtaggtatgctgaaaacaggaattgaaaagttatcagtgggagatcccagagacagtgtggtggtcacccctttgatcgatcagaaagctgctgattttgccgaattcctaattcaggatgccattgccaaaggtgcagaactgattgttggaaataagagagagggaaatttagtctatcctactttgctggataaggtaaccgtggatatggagattgcatggaaagaaccgttttcaccgattcttcctatcatccgggtaaaggatatggaggaaggggtagagatagccaaccgttctgaatatggcttacagtcttccgtatttaccaaagatatcaacaaggcctttcacattgctgaaaaattagaagtaggaaccgtgcagattaataacaagacagaaagaggaccggatcattttccgtttttgggagtaaaagcctccggcatgggaacccagggggtaaggtattccatagaggcgatgacaagaccaaaggcaatcaccattaatttgacagaataaatggaatcaggactgccgtaatatggcagctgaaaaaggtgaatgtggagcagaatttatctgctccgcatttaatgttgatgatatttttgatgattatgctctcttatcgtataagatcaatgcaatcatctcaactggctcattgccgattgcttctattccgtgaccttcatcggtccctgtaaatgtgacatctcctgcagttacggttctgattgttccattatcattgtattttgctgtaccacttaaaatataataggtttccgattcattttcatgaacatgataaccaattgctgaaccaggatatactgtagtatgtccaaatactctgcctgcctgatacatttcttccggtccattcagaagacttctgactaatatttcaccgtttccattaaatgggcttggttttttatcataaatcttctcatctctttgtcgaatcataagttttccttctttatatatagatatttatatgactattaccaactaaatgtattacttattatacttttttgctgcttcgttaaattcatcttctattccaatataatagttaagtcccatatcaatccagtttgacatttcttctttaggaatcccgcccatatcatgctcatcatggaatactgtattacggtccttaagagtttctttaccatatacgtacataccgaacatggaagctttttcaaacacatggcatgtaacaaagttaaagccataaggaatcacatcatcaagatcaatatcagccttgccgttcttactcataacatctggccacatcttccagcctgttacttccctgctcactttttccgcttcttggattgtcttaagaccaatgatcagagtcattatttcaacgcccatgtcctttgccatggcttcagctgctttgcatcggctgattgcctcatgaatcccgtattccaacttgcactctgtacgtgcaataacaagaaaatctgttccctttgctgcttcaagactggctgcaatcttagctaaccatttttcttttgatacgacctcatgcttgatatcgccgtctttgtagccattcatcatggcgaagccccatctgttccaacctctgatacctgttgtatcatcaatcgtacagcctttagcgccggcattgatgagtctcttgatcagacggtatgttgttaacggtgtatcaccaaatccgtcatctgcgtcaacaataagaggaagtgaagagtaattacagattctttctgtagactgaaccagatcatccgcagtaataagtccaatatccggaagtcctgcaatgctttcagccaactgtccgccgcttaacattaatgccttaaatccagataattcagcggctcttgctgtacggcaatcccatacgcatggagcaaaaatctgttcattttttactaactccttaaaggaagctgtttctttttttaaatattcgtttttcatgttggtacatcctttctaataatgttatttttattcaacttaagctgaaagcggataaatgatatttcctaacaccaatgctaatgcaagagctaacagtgtaatgacaacggttaccacgaataagtatttgtacccatccttatatgaaacatctgaaattgcaagaactgcaacaatgccgccgctatggggcaagctgtcaaggcccactgaggcaataacaccaattctgtgcatgattgctggattaactcccattgccatgaatggctcggctaatacggatagtgctgttgataagccgcccataccagaagcatttaatccgcataaaagtgtagtagcaataccaaagatgatcagcggattaccgcctgacgtgctgaagctgagaattccgtctaccatcttgctgaagcctggtgaaattttaactacagaaccaatagcaacaattgcagatgcattgatcgttgttacagcagcgctgttcactgagtctgtaaggatctgctgaactcctgtaatattcttgaagaaaaggattacacataatgcaatacctgataataatgcgactgaaatgtcctgtctgaaaacattaagcacaactgcgacacatacaatagggaggattgaaaggattacattaggtaattttccttttgcttccatttcatctgttttctctaatatttttatcgtattatcatctacttcaaaaccgatctcttttttcctggctttatttgcttcatatgttaagtagataagaattaaaaccagtgtgaatactccgcagacaatgcctaccacaggtgctgccatagcatctgtaggtaaataggaggacggaatgatgttctgtacctggggattaccaggtaacatggtgacccatgtaaatattcccgcaccaattgtcgctggaattaagtatcttggtaaatttgcctttctaaacacagctaatgtaattgggtataatgcaaaacaggaaaccattgcagatacaccgccataagtaagaagaccaccggcaataacaattgcagggattgcaaatttgacccctaacttaccaataataaatgaagctattgatcttgctgcccctgttacatccataacctttgaaaggatggcacctaacaaaagcataagccatgatgattttacaaaatttgaaaatcctgtcatgtaatcgctggtcattgttgaaacaaccggcagccggctgaataatgcgataaagataacactgatcgctgcggcatacacaaccggaactttcttaagtgtaaggataagtaaaatcgcaagacccaacagaataacaaccatatccatatgaaattccctcctattaatttaatcatgttttaaatttttcgttagaagttatgcagctttgatccttacataatgacatttcacgcgtgattaaaacggccttctgctttcagttaaatatcttttgcatacttctggcacgtctgtagtatacaacagttattttagattgcgcaatagtcaaaaacggcaaaaaactttaatatttttatgcatattaactaaacagctcatccatagcaataaaaaacatatattcgtaattgttgctgagaaattgacttttacctgaatgaaaattaagatttaaaagttatatattttgttatttgcaatttttcatattttaatgtagtatataataagtatacaactatttgataaaatgtattaattacggattgcattaggaatgaaaaaagcgtaaaaaataaagtgaattttgagcgggctttaaccaagggttcatgcttcattacttatttgtgcctagagcaaagcgaaaggaatgacaatatttatgaaagaaaaagaaacacaaaacagcaaaggattaaaagaacatacctatcaaattctaaaagaacgaatggttgactgcatttatccaccaggaagtctgttaaatgaagctcaattagcaacagatttaaagttgagccgtacacccatcagggaagcgatcagtaaattggaaatggaaggatttgtaaagattcttcccaaaaaaggaatttatgtaacagatatcacctttaatgaagtgatccaggtattccagacacgttttgaaatcgagccgatcgcgctgcgccttgccggtccccggcttcctaaagaagaacttgcggctctttgtcagaaatttcatgaaccaattatggatatccataacagctttcgtttggatacagcaatgcatctttttatcattgaacattgcgggaatcgttatatcatcgacatgatgcgcagagtattcgaagagaatacacgaattattatttccagcaagcagaatcagctgcaggttcatgatgcaaaaaaagagcatattgatattcttaatatgttaatgaatgacaaataccaggaagcggaagttgcaatgcggattcacattgaatcctgccgaaaggccgcccttgattatttttataacagtcagatctatgtagcggcgccatatagttcctataagaaagagttaaaaaagctgtaatcacccatatatttataattacatttcttcaatcatctccgttgactcttataaaataatccccgccagctatgattcattatcatttctgatggggatatatctatttttgtaagcatattaatttcctccttttttacttcttcaaagaagtgagagaagggcatctggcttttgcaccacctctatcacttcaaattcagcttcagaaattcatggcaaagctgtcataatgaagatgaaaaagaaaaagcgtatagataatatctattaataaccatttacttattgttttaatcaattggactcaaaagcaatacatctttataattaatagatgtagcaaaaaatatacatattgggagataaagtcttatgaagaaaagggtactgggtacattgctgtgctttgccatggcagcgtccctgacggcaggctgtggggaaaagcctgacagtaaaccggctgacagcgggatgacgacagcagaggaagaaaaatctgatgtaaaagctgatccggtggataaaaaaaaggtgtacgtatcaacggactgggtgcagagtgtgattgacggaaatcaggaagagtcttctgattatgtgattctggaatgtgcatggggagaggaagcagatgacccggcatacacggaaggtcatattaagggtgcttaccatatgaatacggattatattgagtctgaagaatattggaacatccgcacaccggaggaaatagaaaagctgatggctgattacggaattacaaaggataccaccgtaatatgctatggagcagatggagtgaattccgcagacgacagagtggcatttacgcttctctgggctggagtggaaaatgtaaaatgcttagatggcggttttgaggcctggacaaaggccggatacaccgctgaaaaaggcagtaacaagccggaggcaactgataagggatttggaacaacggttcccgcccatccggaatatgttatttccattgctgatgtaaaagaaaagcttgagaatgacagcaacttcaaattagtgagcatcagaagcatagcggagttttcaggagaaaccagcggatacggctatattgacaaggcgggagaaccaaaaggcgcgatttggggacatgatacagacgacggttcctacaataaagaagacggaacaacagtgggtatagatgtgctggaaggatatttaaaagaatccggagcctcccttgataatgaactggcattttactgcggtacgggctggagagccactgtcccattcctgatctgctacgaaaacggaaataccaatgcaaagctttatgatggcggctggttccagtggcagatggatgacagtcttccagtacaggtaggagatcctgaaaacggtaaatgtgaatataccacggtaggaaatcttaccaaggataaagctaaaaaataaaaatgaatatcatgagcgctggacgcggaagcggcagcgcttattttagcatgggaagacagaaaaatgaaaagagtcggatattttatcgtgacatttgcagaaattctttttttagccggcgtttatatcatccagtattttacccggcgaaaaatgggaatggcaagatatgtgatttataaaaatcaaggctgggagcgggctttcccaatggaagcattgaaatatacggcagcggcagttttgacggcattgactcttttgcttttggcagcgctggttaaaaggcggaagcagctggggcggctggttgttgccattcattttgttatgctgatactgacagcggtgtatggagcttatacctgtatcagctccactgagacaatgagagcgtattattttatcagcctgatgcttggagcggcagcactgcttcagatcataaaagcgggagcggcacttttcatgtgcaggaagaaaagagatgaaaaataaaaaaatatggatatttgcagggatcatcctggtgattcttggcctgaatcatatatttggctggtcttcctatatcagtaatatgaataatctgttttttttaaagcgggcggtacgggataatcttccctatgctgttgcaatctacacaattctcaccattgcgggctgtgcctttctggcgcttcctggagtaacatttgcaatccttgcgggccttttgttcggaccaatacttgggacgatatgctgttccgtggcgactacaatgggagcggtcctcgcttttgcggcaggaagattctttttaaaagacagcatcaggccaatggtaataaaaaacaggtatttgaacaaatggctgtttgacaccacaggaaaaaaccaattgtttattctcatcattacaaggcttgtcccggtattcccctacaatcttcaaaattttgcctatggaattacggatattaaattcagcacctacatgatcggttctctggtttttatgctgccggggactgccatgtatacggttggaacagccgggcttgcagacagagaaaaccgtctgctgtatatgggaatcgctgcagcgctggccataacagtgatgggaatgggggtattcctaaagaagagatacatactggagggacaggatgaacgataagctgagaatcattgatccggaagcctgcattcattgccatgcatgccggcagcactgtctttttctggaaaaatataatttggatatcggtgatgaggaaaagttaaaggagctttcctaccattgctttttatgcggcaaatgttcccaggtctgcccaaagggaatcgacgggagagagatcattttaggtatgcgaaaggaccaggtgcggagcaatcgtggaaagcttcctgaaaaaggttatgggatgcttgtgagagaaaagcaaaactatttattccagaattacagaaatggggcgaataagagcgtgctttttccaggctgcaattttccggccttttatccggagacaaccaggtacttaatggagctgttccgggaaaagacaggcgccggaacagtctttgactgctgcggaaaacccgttgcagagctgggaatggaactgcaggagaaacagatcattaaaaggatggggagaaagctaagggaaaacggtgtggaggaagtgatcaccctttgtccaaactgctacgtttatttaaaaccccgtttgagcgtcaaagtagtgagcatatatgaaaaactacgggagcttggaattgggaagaggattgagggaaggcttaccattttcccgccttgcccggacagggaagacaaggagctgctgggtaccataggtgcatttttaacagaggaaccggatattatttctcatgtccagtgctgcgggcttggaggctgtgccgggaaaagggaaaaagagctggcagaacagatggcaggcagccttggacaggagaaaaagaagcctatttatacatactgtgcttcctgttccgggaattttgtaagaaaaggatataagaataccaaacatattcttttagaaatattagaaagaaacgagcggccggacacaggccgatctgtggttaaccgcataaaaaccaagtaccggagagaaaaataatggctgaaaaaaataaatggattaaaaagttagtgacgatcttagtaattgcggccgggatcatgagttattatgggattccatcggtaagagaaaccatgaaccaggtatttaagatgcttgcaagcggagattttggggtggtgaaggattttatcgcatcctgggggacgtatgcggccgtgatatcctttggactcatgatattccagtccgttgcggcgccgctgccggcctttctcattacctttgccaatgccaatctgttcgggtggtggcagggggccattctctcgtggacaagcgccatggcaggagcggcgttgtgcttctttattgcaagagttctgggaagggatgcagcagagaggctggcaagcaaaaccggtttaaggcaggttgatgcgttctttgaaaaatacggaaaaagtacggttttggtctgccgccttttgcccttcgtatcctttgatcttgtaagctatggggcagggcttacctccatgtcctttggttccttcttccttgcaaccggaatcggacagctcccggctaccattgtgtattcctatgtaggagggatgctgacaggaggagcaaagctatttgtgactggactgatgattttgtttgcattgtcggcgctgattgttatggcaagaaaaatatacgtggaaagacaaatgaaaaaaggagaggagtaagaatggatgcttgcgaaagaaaaacgatccggtttgaagaaatcaaggagttattcatgcagggaattgactgctcccaggtagttgcgggagagtttgcagaagagttaggactggataagggactgctgaggaaagcttccgcctgctttggcggtgggatgcagtgcggagaaacctgcggtgccgtcactggcgctttgatggttcttggagtgaagtatggacacagccaggagggggataaagagcagaagcaggttatgatgaagaaaaccggagaatttaagaagctgtttggggagaaatatccttcctgcatctgccgtgatctccttggacatgatatttccaggagagaagaactggaaaaggtgatggagaaagggctgcttctccagttctgtccaaaggtcgtggaagacaccatagaaattttaggaaagattatatagatgaaacaagcgattattatatttacaagagtgccggtgccgggaaagacaaagaccaggatgatgccacggcttactcctcagcaatgtgcaaagcttcatatctgctttttaaaagacattggaaaggaatgtgagaagtgcccggcggatatctttgtctgccatactccggatggggaaaaagaaaaaagactgctaagggcggtccttgggaaacagaggggatattttcagcagcagggggaggatctgggggaacggatgtaccgggcatttgaagaggtatttgccaggggtatgaggaatgcgttctcattggaaccgacgtgccggagctgcggtccttccatttaagacaggcatttgaggtgcttaaaaagcaggatgtggtgtttgggaaaacctatgacggagggtattatctcatagggatgaagaaagcccgcccggaggcttttggtcttgaccattatgggcataaagccgttctggatgaaaccataaaggagctttcccaggccggaatttcagttggctatacgaaacggttatgggatttggacacccccatggacttaaaagcgtatcggaaacggatgcggttcagaaaagagctgaaacagacggaaaccgggcggtatgctgcaaggattacttcggtctcaatcattgttccggtctataatgaagaaaaaggaattgtaaagctgcaggagcagctaaaggaactggggagaaatgtgaactattgtttgtggatggaggaagcacagaccgcacactggaattcatagagccaggatataccgtgatccacagtgaaaaaggaaggggaagccagatgaatgcaggggcaaaggcgagcagtggtgatattttgttctttctccactgtgacagtgagcttcctccaaagcctttggcagaaatcaggcgggtgatgaaagttcatcaggcaggctgttttggaatagcatttcactcccataattttttcatgtttacatgcagggtgatttccaaccacagaataaaggaccggaaggtcatgttcggggatcaggggatctttgtggaccgggagctgttttttgaagttggaatgtttcccgagattcctatcatggaagactaccagttttcactggccttaaaagaaagaggagtgaagctggggatggcaaggaggagaatccatacctcggacagacgatttcccaaaggtacaataccaaagctgaagctcatgtggaaaatgaaccggcttcggaagctgtaccgggagggggttccaatagaaaagatttcggatatgtaccgggatgtgagataagagggaaggttgaagaaaagtatttcccttgatttattaggaggcaaaaatatggatcaggtacagggattagcggactatattaaatggatagaataccgggaaaggctgggacttcccaggaaagtgacagaggaataccggatgctggggcaggagagtacaacagaaactatctgtttattcatccggtcactggtaagaagcttattctgcgggtgaatttcggaagccagatgcatctggaaaaccagattgaatacgaattccgtgcattggagctgttaaaggattcgggacgcacgccaagacccttgtatgtggatggaacaaaggagaagattccttatggagtcatggtgatggagtatcttccggggcatgcactggattatgaaaaagagctgctttatgcggcagactgtctggcagatatacacagcatccccgttggcagagaaccacccctcatagctccggataatccattaaaagcaattctggaagagtgcgaggagatgttccgaaagtatgaggaatccggtcttggtgacgaagaaaataagagaaaaatacgcaggctgctggaaagaggctggaaaaaggcagatattctgccaaaagtaacctactgctgctgcatcaatacggagctgaattctacgaattttctcatcaacggggaaggaaaggggaattatctcattgactgggagaagccggtttacggtgatccggcacaggacctgggacattttcttgcgccgaccacaaccttctggaagacagatgtgatcctggaaagggaacaaatggatcagtttataaaagcgtatataaaaaaggcggcagacagattcgatacacagggtctgaaagagcggatcagtacgtatattcccattacgtgcttacggggaattacctggtgcgcaatggcctgggtggaatatcagcagccgggcaaagaaatatttaatgagtccacggcacacaagctggaggcgtatttgagtcatggatttttggataaaatagcagaatatgtgggttaaaaagatacctgtaacaggtgaaaaaacaaacaccaagtgatggcagttccgcttaaacaaagcggaaagaaccatatattattatgacgcgctaaaaaagtatagcgccggaaaaccaaggaggaataaaatatgaaaaagaagtttttagcagttgccttagtgtctgcaatagcggtgtccatgattgcaggatgcagcacagaaagtgcgggagagaagaaagtaacagctgcagtggaaagcacagcagcagaaagcacgtcagcagcagatagttcagcagcggaaagtacatcagtggcggaaaacacagggaaagaagaataccagtttgtatctgccgaggatgcggtaaaagcggctgctgacggaaaaacgcatgttcttgatgtaagagagtgggcaaactacggggtaggaagagttgctgattcggaatggtgtcccattttccccctggaggatgaatccctggcagatcagatgaagacatatgcggaagaaaatttaaaagacggacagaacatctacatcatctgcaacagcggccagagaggcgcacagaagtcaacaaaggttctggaagaagccggaatcgacgcagcccttatctttacggttgagggaggcgcaaaagctctggcaaaagtaaaaggtgcgctgacaacaaaccgtgcggaagaaggaataaactggcagtatgtaaaagcagcagacgtacttgggaaaaaggatgcacagattgtggatgtacgtgataacgatacatatgcaggaggacatttggaaaattctcttcaggttgatttaaaagaatttgaaagtgctgatgcacaggcagcaatgtatgaactggcagcagagaagcttaataaagacgaacctgtatatttcttatgttacagcggaaataaatgcgcaaagacagccatttctgtgttaaaggatgcaggctttgatgaaaagaatttgttcatcattgaaaacggggcaaaagacagtgacattcaggcggcatttgtaaaataacaagcctgcagccggaaaacagtaagagacggagaaaagagatgaaaaagagaatttcggcagcgcttctggcagttgtaatagcttgttccatgacagcctgcggaaacaatgaaggaccaaaagaagagaaaaaacaggtttcagaaacagaagagatgtccttcggcagtatgaaggaggaagcaaagggtactgttgttacgttttatggctggggcggagatgagaagctgaataaatggctggacaatacctttgcccccgtcatgaaggaaaagtatgatattaccatggagcgtgttcccatggacattgaccaggtactaagccagttgtctggggaaattcaggcgggggaaaaggacggaagcattgacatgatctggatcaatggagaaaacttccggtcagccaaagaaaacagcatgctctacgggccattcgccgataaactgcctaattttcaggattacgtggacccaaattccgaagatgtaacacttgattttgcataccccattgaaggatttgaagctccttatggtaaagcgcagatcgtgatgatcggggatactgcggtaactccggacttgcctgaaagtgccgaaggtttaaaggagtttgtccggaaatatcctggaaaggtgacctatccggcacttccggattttacaggaagtgcgtttgtcagaaatattatctatgaactatgcggatacgagcagtttctggatatgaaaggggataaggaaacagtgagagctgccgtagaacctgcaatgacgtatctaagagagttaaacccgtatttgtggaatgaaggaaagaccttcccggattcctcaacgacccttgacaatatgtttgcagacggagaggttgtgctgaatatgacgtatgatgcctacggaaccgctgtgaagattgcagatggggcatatacgcagacaacacagtccttccagtttgacaaagggacgatcggaaataccaactttatggccattgcggccaattccggaaataaggcaggggcaatggtggcaatcaatgaaatgctgtctccggaaattcaggctgaccgctataacaccttgaaagtcattccggttcttgacaattcaaagctttcaaaggaacagaaggatgaatttgatcaggtggagcttggaaagggaacgattccccaggatgagctgctgttaaaacgtcttccggaaatgcccgctgagctggttcccattattgaggaaatatggacggaagaagtggcaggaaaataatgaaaaaaaagctgatgccatatttatttctggctccccaaatattgctgactattttatttatggtcggattaataactggaattacccaaagcttaggggtaattccagcttttgggttaaagaagccaacgcttttatactataaggaagttctgacacggccggatatgcttaagtccatgggatacagtcttaaaatagccttgttttcatcggctcttgcaacggcagggggtgtgtttttttgcggcgtatgcgtgatgggaaagaaaacccggggagcggtcatgcgcatcatccaggttcctattattgttccccatgtggttgcggcactttttatcatcaatattttttccagaaacgggatcctggccagggccgcatatgccctgggcttgattcaggagcagcagcagtttcccatgctcatctatgatccccaggggatgggaatcattatggcgtatttatggaaagaaattccctttatcatttatttcgtcattgcgctgatggcgaatattaacggaagcctgggggaagcggccacaaacctgggggcaaaaacctggaccgtattctggaaggtgaccctgcccttatgcagaaatacaattataagcggctttctgatcatttttgtatttgccctgggagcctatgagcttcccctccttcttggagcgacggttccaaaggcattgccggttcttgcatatcaggagtatatccatccggatctgagaaaccgtccttatgccatggctttaaatggtattattattgtgatctcccttatcagcgcgctgatatattttttaatgatgcggaaaaatgtgaaatgtttaacggatgaaaactaaccatgaaaaataaaagaaagtcaatattaacaagcatcacacagttccttttgatggctgccatacttattccgacggtcactctgtttatatggatctttacggagcggtggacgtggccggatctggtgcctcaggtgttttcaaagagagcgcttttagaaatagcaggaagaaaaaaagagcttttgcaaatcttccggtcaagcattttgatttccacggttgtggcggcattatctgcggtgatcggcctaatgactgcgagagccatgatattataccgttttcccggaaagcagctgatgtatttttttaccatcctgccctttatggttcctgcaaccgtgtttgcaatggggatacagattacgtttattaaaatgagactaaacaacaggattacaggggtcatcatttctcatttggtctgttctcttccttatgctgtgcgactcatcatggatgggacgatggctgttggcaacagactggaggagcaggcaagagtcctgggagcatctccctttcaagccttttacaaaacgtctctccctttgctggcgcctgtgatcctatcagctatgagcatgtcatatattgtgtccttcagccagtattttctcacgctgataatcggagggggaaacgtaaagacctttacgatccttatggttccctatctgcaaagcgggaatagaaacattgcatgtatttacagcgttctgtttctgggcgtcacattgctggtgtttggagtgtttgagtgggcggcaggccattggatgaaacatgggggcggagaattttatacatgaacatgagatgaatcagggaaaaggatgagagaagccatgagccttacggttgaaaatataaaagttgtactgcagaagaaagagattcttcatgggatcagcctggatatacgggaaggggaatttacctcccttcttggtgtgtccgggtgcgggaagacaacgcttttgaaaagcatagcaggacttctggaaatccagcagggagatgtgcggattaatcatgtatctgttacagggattcctcccgaaaaaagaggaacagtcattgtctttcaggatttaaggctgttcccccacatgaccgtggagcagaatatcgcatttcccatggagcttcaaaaggtttctaagaatgtccggaaggaaacggtgaaaagattgctggaagaagttcagcttccgggctttgagaaccggaaaataaaagaaatgtccggagggcagatgcagagagttgcactggcaagagcccttgcagcaaatcctagagtgctgcttctggatgaaccgttttccgggctggatgagtgcttaaggctggagatggggaatcttgtgaaaaggcttcaacaggagcggaagatcaccacggttcttgttacccatgaaaaaaaagaagcattgcagatgtcggacaggattgcgctgatgagggagggacagattttacagtacgatacaccgaagaatatgttccggcatcccacttcaagggctgtggcggaatatttcggcagggtgaactatgtgaaaggaagaattgagaaccgcaggttttacagcgggctgtttgaaatgagtgcaaagctggatgacggggattatgaggcgatgataaggcccttctccgtgaagcttcagaaagaggggcctatgtgatttcaggaattacatttatgggagagacggcggaagtgaagatagagataccggagggcacgattttaagccatgtcatgagtcacgagctggaagggcttggactggaagaaggggacagggcgggtgttttcatagaggaaaacgcagtgacctggtttcggagagaagggtgaaatcaaatgaagcatgtggtatttgactgtgacaatacatttggagtaaaggactgtgatgtggatgacgggcttgccctgatgtaccttcttggctgccctgaggcaaaggtgcacggaattacggcaacgtatgggaacaaccgattggatattgtatacaatacaaaccggaagatgctaaaggatctgggacgtgaggatattccggtgaaaaggggcggggcaaaatgcggagaatatgaaagtgaggcggcggattatctcggggaaatggcggataagtataaggggaccttatcaattcttgcaaccggttcccttacaaatcttcggggagcttatgaaaaggacaatcatttttttgagaaggtaaaagaaattgtggtaatgggaggattacaagccctcttgtgtttgagaaaaaggtgatggatgagctgaatttctcctgtgatccctttgcttcacaaacagtgcttacaaaaggaaaaaatgtttctgtgatcacagggaatcattgcctgaaggtgctgtttacaagggaggaatataaggaacgcttatttggcacggacaacaaggctgccgcatacatccgggagaagacggattactggtttgggtataatgaggaagactatggtatcgggggattttataactgggatgtgacggcagcggtgtatctgatgcatccggagctgttcgtggatgagagaaggacgctgatggtatcaatagaggatttaaaacaaggctatctgcgggaagcggaggtgggaaactgcgtgtgcaatcttccggagattggagaggaaaaggtctataaagatcatatttatgatgcgtggatgcgggtttccatggagtaaggcggatgatcatagatgatattttataacatatggaatgttaccagatgaagatgatgactggcgcagcgaaaaagggatgaagagaccttttccgctgcgccatttaatttttgtaaatttaatggttaggctgttggcggatgataatccacggtttgcggcaggagaaaccgtatgtaatcagattgccagaacctgcaattgaaaaatcctttattattttgattttttagtgctaagtattttacatggtatcattattcgtgaatttgtaaaaaaacaaaccatgtgataacgatgtctattttttaagatattcataagtgtaatgataaatcattgcctgatgaaacttctcataatcgtgctcatagagtgccttaataatgcgctcgtgcttttcaatcgttatctcaatggatttcgaggaaagctttgtggtgtaatatttgtcatacgcccagaagaaatcaatgatagaagagaggagtacattgtctactttcgaaaacatggttttatgaaacattgcatctgcttttgcaaattcaatgcctaggggctttgttccgccatgatccacacccaggtggctttgcatgatggtcacctgttcgttcatccggtcaatatctgccagtcccaggctgtaaaaggccttctgatcaaaacccagctccagaacatgacgcaattcctcaatataatccttgatcttgctgtcattggaagcgtcaacatgtgaaatcagcgaagacatgaaaaaatccgagttaaattctctgataatgatgccgacacctggcttggaggtcacgacgccggtgatctctaaggatttaagtgcttccctgagtacattccggctcacacccagtgactcgcagatttccatttccgtgggaagtttatctcctggctgaagattatgctccttaatatattgcttgatttcatcgtatacctgtaaatacaattttctggtttttaaatttttcataagtcaacaatccattctgaattatatttgtagtacaaagtaataactttcttaatattataatttatatttaaatgcgtgtcaatgtaagaaacataaaaactaaaataaaaacttatagaaataaaaaatatgtgaataatgcacaaataataatgtgatattcggtgaggttgttagttgacatttaaaaaaagttaattaaacttaggatatcaattgcaagtttatactttatactacaaagtacaaataggaaagggaggttatttatgaaacaaagaaaacttgtgagtattttatgtgccgtttccctggccgcgtcacttttgatcggctgcagcggcaaacagcagccggcatcagacacagcaggaacaggggcaaagacagagagtgccaaatccggggatccagggactgggaatccgggtactgaaagcggtgaagcgcctggaaccccgcttgcagatttaagagtcagacaggccctggcttatgcgattgacatggatgcaattgttgagacgctgtttaacggcaaagcgcaggcagcaaaaagttttaccgctccaggggattggctgaacgcagaaatccctacatataagtatgatccggaaaaggcaaaagagcttttaaaggaagccggctggccatcggattatactcttgatgtggtttattattacgatgaccagcagaccgttgacttaatgaccatcattgggcagtactggcaggaggcaggggttaaggcccagttcagaaagctggaaggtgatctggctgcacagctttgggtcccgccggtggatcgggtaaagggcccttctgtagtaaaatgggatctggcttatgctgcggtggctgcattggcagaatccgaattctataacagattcagttcgactgcctccaataactccaccgttccaaagcaggaagggcttgatgatttaattatttcagccaacgggaccatggatacggacgagcagaaaaaggcgtttggtgaaatccagaattttgtggcagagaatgtaattgcactgcccctttaccatcaggtctgctttatttataacagcaaagatcttgatatggcaggagcgggattcgggaacgaccagttctcatatgagaagcacatcctggactggaagatcagccgggatgaccgtacgatgtatacaaatggcgggcctcaggaatttttctggtatcctttggtgaatccgggactcctgattaatacggagctgatttttgataagcttataaacgcagatgaaaatctaaatccgaaggaaggcatgctggcccaggactataaggtcagtgaggattccaaatccattgagttcacgcttcgcgacaatctaaaatggcacgatgaccagcctcttacggctgaggatgttaagtttaccattgagctgatgcttaaggctcccggaaccaatgcggttgcctcggaggtcatgaaggcaatccatggtgcccaggactttattgacggaaaaacggaacatttagaaggcgtagtgactgatgggaataagatcacggtcaattttgatcaggtttccgccaatgcgctgcaagtatttgcccagtggcccattcttcccaaacactgtcttgaaaaggcagacccggcagcactccagcaggatgggttctggcagaaaccaatcgggtccgggccattcagggttgatgaggtggtgctgaacaattacgcgaccttaaagagatgggatggatattacaagaccggaaacgggaatatcgaaacaatttacatgtttgcaagcggtgaaaatgatgcaaaccttgtaaagaatgcgggagcaggcaagattgactacgcatggtccaagtctacggacgaagcaaaggcaatcgagaccatggatcatatgaaggtcaatacggcaaatatcagatatacaagatgcttttttatcaatcagtttccccatgacgcaaatattaagtaaattccattgatgaagcatataaacggtggatctgaaggttcaccgtttataacaggaggaattaaatggctacttatactatcagaaagattttatcgttaattccaatgatgctagtcatcagctttctcatttatctgggaattgaactgatgccaggtgatgcggttgatttccttattccgccggatgcgctttccacgatgtcggcacaacagcttgaacagatgagaaactctcttggcttaaatgatccgtttgtcatccggtactttaaatggctgtgggggatcctgcacggcgactttggctattccctgcagtcgggagtacctgttgcggaaattatgaggaatcatatttcggcaaccattgaattatctgtagcatctctgatcatgtcttctgtattcggcatttttctgggcgtgatcagtgcactgaataagggaagtgtactggatcatattctggacgtagtgggaatggtcggtgtggcgatcccccaatttttattcggtctcatctgtatcaatgccctggctctccatcacagcattctgccggtaggagggcggatggcttatgccgggcagagctttattcagagattgccgtatttaatcctgcctgcagcggtcctgggcttttccatgacagccggtgttatgcggtatgccaggggcagcatgctggaatccatgggcagggattatatgaagaccgcaagatcgaaaggaatcccggagtggagggtgaatctcctccatggtctcagggcagcggtgacccctgttgtggtattgattggattccggctgcctatgctgatcggcggagcggttgttgtggaggaggtattccagtggcctggaatcggcggtctgttcatcaaggccgtgcgggcgcagaacactccccttgttatgatgattggatttttttccgtgctgatcgttctggtgtcaagcattttggttgatttagttaccgccatgctggatcctcgcataaaactgagttaggaggtatgggatctatgagtgcattaaacaaaaaaatggatcagatccttgctcaggaggagtccgggaaagcaaagaaacggttgaaaagcagggtgttaaggaaaatgcttgccaataagctttctattgcaggtcttattatttttattgttatcttttttatctgctttgcagctccccttatcacctcctattcatctactaagatcgatttaaggagcattctgcaggcgccgtcagccaagcacattctcggtacggataaaatcggacgtgatatctttgcaagaatcctgtatggaggcagaatttccattgcagtaggcttaggctccgcgttgattgccaccctgttcggtgtttctctgggtacgattgcaggctataagggagggctggcagacgggattgtcatgaagatttcagagattttaatggcgtttccccagatgatcatggtcctgatccttgtgaccataaccgggcagagcctgtggaatctgatcttcatattttccataaccggctggccttccatgtaccgaatggccagatcccagatgctttctctgcgggaggaggattatgtccaggccttaaaggcatttggcataggatccatgaggatcgctttttttcatatgcttcccaacgcaattggccctatttttgttaacataacattgtcaacggcgatgttcattcttcaggagacatcacttagtttccttgggctgggtgttcccctggaggtggccacctggggaaatatattgaatgcggcacaggatattatgatactaagggatgcatggtgggtctgggtacctgccggtgttgtggtgaccctgtttgttatcagcatcaactttattggcgatggcttaagagatgcagcagatccgtctcaaatcggttaaggaggaaggtcagatgagtcatgatacggtagtaaatgttaaaaacctccatgtgaacttttacaacaatgatcgctgcaatcaggtaatcagaggaatcaactttgatttaaaaaagcgaaggattctatgtatcgtgggagagagcggctgcgggaaatcagtcactgcaaattccatcatggggctgcttcctgatctttcccggattgaaaaaggggaaattcatttttttaacgatgacaaggatatcaggatcgatcagctaaagcgaaaaggaagtgaaatgcgtaagatccggggcagcggtatttccatgatattccaggatccaatgacggccctgaatcctgtgtttaccgtaggatatcagatcaatgaagcacttctttctcatggaagagccaaaaacaaagcggaagcaacaaggaaatccatagggcttttaaaggaaatgggtatcccgatgcctgaaaaacggttttatgaataccctcatcagttttccgggggatgtgccagcgcgccatgattgccatggcaatgagctgcagacccagagtgctgatcgcagatgaaccgactacagccctggatgtcacgattcaggctcagatatttgaattgatgctggatttgaagaataacaatgataccgctattctgttgatcacccatgatatgggtgtagtggccgaactggcagatgatgttgcggtgatgtatatgggaaatatcgtagagagcggagatgccaggtcggtcctgacggagccttcccatccttatacaaaggcactgctgaattccattcctgttctgggacggggaaaaaagcagaagcttgagccgatcaaaggttccactccggatccttataaccgtccgccgggctgccagtttgctccaagatgtccatatgcggcaccggtatgtgaggaaaaacttccggatgagcatctgacagctccagggcatatgtgcaggtgtgtctgtgactgtttaatagaggagggccggcatcatgagtgagaataaggagagaaaagaaatactgatctctgtgaaaggattaaggacctactacccggtcaaaaagggaatatttaaaaggactgccggctatgtaaaggcggtggaccatgtggatctggatattttcacaggggagatccttggagttgtaggggaatcgggctgtggaaaaaccacccttggaaaaagcatcctgcagctgatcagaccgttttcaggagaagtgttctatcatttcccggaaggagagaaggacattacaaaggtgcctaaaaaggaactggacgatgcccgtaaaaaaatgcagatcgttttccagaacccctattcctctttgaatccctctttcaccatattcggaacaatgcaggaaccgttgctccggtttgggatgaagagcaaaaaggaaagacgggagaagatcgcgaaacttctggaggaggtaaatcttcctcaggagtatatggaacggtatcccaatgaattttcaggaggacaaaggcagcggatcggtattgccagggcactttccgtggatcctgagtttattgtatgtgacgaagcggtttctgcactggatgtttccattcaggcccaggtattgcagctgttaaaggaattgaaggaaaagaaaaatctgacctatctgttcataactcatgatctgtctgtcgtggagtatatcagtgaccggattgcagtgatgtatctggggcatattgtggaactggcggagacccgggagatttttgagaacaccttgcatccatatacgcaagccctgctgagcgccattcccattgcggatattgacaggcgccgtaagagaattccccttcagggagatgtcccaagtccggtggatccgcccggcggatgtccctttcatccccgatgtcccaaatgcttcccgcgctgcaggacggaaatacccggagcacacaggatcaatcataacggccatgagcatctggtatgctgtcatctggccgaaaacttataaactggaggttaacatgagtaaatttcaaattacagatataaaaggagtaattcctgcaacaatggcattttttgatgaaaaagagaatattgatgaagcctgtacaaggaatatgacagaatttatgcttggagcaggagtaaatgggttttatttaaccggaagtacaggagaatgttttaccatgacaccggaagaaagaaaccgggtggttgatatcgttattgaccaggtaaagggaagggtgccggtgatcgttcacgttggggatatcggaaccagaaaaagcataggtctggcagagcatgcggaggcagcaggggcagatgccatttcatcggttcctcctttctattggaaattttcaaaagaagatatttatcattattataaagacattgcaaaatccaccagtcttccgatgattgtttataacattcaactggcaggaatcatggacaaagacttaatccttaaaatagcagagatcgatcatgtgaaaggactgaaatataccgccaggagccatgatgagatggggtctttaaaagagatactgggaaaggatttcatgatttattcgggatgtgatgagatggccttttccggattatgttttggagcggatgggctgatcggttccttctataatgtaattccggaaatttacgaaaaaatataccgatgtgttcaaaacagcgatataccgggaggcatccggcttcagcggattgcagatgaatttatctttgcatgccttcaatacgattttccgtcctgtgtacataacctaatgagatggagagggcttgaaggcggctgttccaggcggccattccataattatcaggatgaggaactggatgatttaaaaataaaattaaggctgatcaaggaaaagtatcaggccgaggatctggaaatgttctgtttttaagagcaaagacccccattttaaatggcaaaaatggggggccttttgtctgccagccatatgtactgacaaaaaaagagcacagtgtatataattaccataccatatgcagcacagtaaagcgttccatacgcttaccgcatcaaaaaggttcatgcagtgataatattggcaaaaaaagcatgatatacaaagcacatgggaataatacgttcgtatgtgcctaagaccagatctgaacgatatttttaagaaaatattaatgatttatcatggaaaaaataaaaatcagccccatacataatggtaaaatcatacataactgacgttcagggaaaggaattaaaatctatgcaggaaaaaatacttgtcgtggatgacgagcacgagatttcagatttggtagaactttatttacaaaatgaaaattattcggtatttaagttttataacgcaaaagaagctcttgcttgcattgagactacggagcttgatcttgctattttagacatcatgctgccggatatgagcggttttgcactctgccagaagattagggagaagcatgcctacccgatcatcatgttaaccgcaaaggatcaggagattgataaaattaccggactcaccctgggagccgatgattatattacaaagccgtttcgtccgttggagctggtcgcgcgggtaaaagcacagctgcggcgctataaaaagtacaattcggttcaagcaaatacatctgaagaaagtgttatcgtgcattctggtttggtgttgaatagcagcacccatgaatgtcttttgaatgaaaaaacactggatcttacgcctaccgagttttacattctccgtattcttctggaacgaaaagggaaagtagtcagcgcggaagagctctttcgtgaaatctggaaagacgagtattacacgaagagcaataacaccatcactgtccatatccgccacctgcgtgaaaaaatgggggatactgtggagaatccacaatatatcaagacaatatggggagtggggtacaaaattgaaatataatttacaggaagcatccggatacagaaagttcaggcaaaagatgctttggcagctgattcttatggctgttttatcattttccgtaattgtgataatctatatgatggtttggaaaggcaaagtaggtgacctgctggtaaaattttttcaaaaagtcttgcacatgacgcaggaagaagcatttgccgcctatcactatctgttccgctataactttggtctttttttcctcggtgccgcgtttatcgtgttttttctgttgctgttcatttttctccagcggttcacccgatattttgatataatcaatcgtggaattgatgcattggtgtcagaacaggatgacttcatccaacttgttcctgaaatggccgccattgaggagaagctgaacactgtccgcaagactttgtctgaccgtgcttaccgtgcccaggaagcagagcagaggaaaaatgaccttatcatgtatctggctcacgatatacggacgccgctcacatctgtgattggttatctaagcctgttagatgaagccccggacatgccgttggagcaaagggcaaaatatgtccatattacattggagaaagcataccgtctggaaaatctggtaaatgagttttttgagatcacccgctataattcgcaacagattaagcttgaaaatcaagtagttgatttatattatttgctggttcaaatggcggacgaattttatccggtacttacccctaaaggaaataccatagcggtccacgcggatgaaaacctgaccgcttatggagatcccacacagttggcacgtgtgttcaataacattctaaaaaacgcggtggcgtacagcaatccccattcggaaatctctatttccgccggggaatggaatcatcaggtggtgattacgtttcgaaatcagggaacgacgatccccgctgaagagttatcctctattttcgagaaattttaccggctggacaaagcccgtgcctcgaatacaggaggagctggtttggggttggccattgcaaaggaaatcataaccatgcacggaggaacgataatggcggatagtaaagacggtattacggcctttacggtatctcttccggttatggattagtaagatatcaatcggatattaggcttttcttaggaattaaacaactccatattaaaatgcaggaagctcctgtctggtaatatatttaccagcaggagcttcctgcattcgagtcatttaaaggagagaacttaattatgatggttaattgcaataataattttagcggctatgaaaggaaaagaagattgaaagaacattcacacattagaaaaatccatattatattaaggctgatctcagtggcagcggtcatgggcctgctctggtactgcatcaatggtttgaacttaaaagaagtttcgcccgaacatatgatatccgttgggacgggcagtttcaacgtcagttcagccgatatggaaaaaagtgataccgacgagacctcgtggagcctgattttagtcaaccgttggaatgcgattccagaggattataacgtagatttaaccgaattatcaaatgggcaaactgttgatactcggatatacccagcacttcagaagatgtttgatgcagcaagagctgacggtgtttatcccgtggtcgtttcaggataccgaacggctgaaaaacagcagagcttaatgaatgagaaaattgccgcatataaagcagaaggatataccgcttcccaggcaaaaacggaggcggaaacatgggtcgccattcctggcacaagcgagcatcagttaggaatcgcagtggatatcaacgcggatggggttaaatcaaagggaagtgaagtttataaatggctgaaacaaaacggttaccgttttggatttatcctccgctatccgccggataaaacagaaatcaccggtgtcagcaatgaaccgtggcattatcgctatgtaggaattaaggctgccgccacaatgcacgaacaaaacctctgcctggaggaatatttgagagaaagaaattgaaaagaggattatccgagtacagcgtttcacttcaaactgctcatgcggtcatcagtcatatggaccggtcagagaacacgccagtgctaaccggcatattgcccagaggtgattatggcagtgactcacttgtgtgagaaggagggcaagctgcgacagcagcaacagagatcagattttatgataccgctcccataaaattagtgaacaagtggagcgaattttaaggagaataatagattaaataaaaaaataaccaaaaaatattgaaaatatggtgttgacacataaaaagtgctgtgttaatatgaatttacaatatgagggaccggtaccataaccgaaatagaagcgcaaggagaaagatatgctgacaattcatgaagtggcagagctggcaggtgtttcgaaatcaactgtatccagagttttaaataataatggctatgtaaatgaggagaccagacgcaggattgagaaaattatacaggaacaccaatataagccgtctgcggcagcagtcagtctttccaaacagatcgggagcacaatcggtgtggttatccctgagatagacaataccttttttggggaagttctaaagggaattaatgaagtggctgatcagaatggtttttctatcatctattgtgacacacaaaataatggtgataaagaactgaaggcattatcagccctggaacagcagcgggtccggggagtgattattacacctgccatggggtatggcgataaagagtctgtggataagctaaagaatgctttggcaaaactggatgtaccggtggtagtggtagacagggattttgattattcccagtgggatacgatttattttcaaaactatgagagcggttatattgcaacggaaagcatgatcaaggccgggagcacaaaaatcggaattattcaaggtgatatgcagcttaaaatagccagggagaggtttcggggatatcaggatgccatggcggcaaatggactggagattccggagcagtttgtgctgaaaggggattttaccatagagacggcctatgctctgaccaaacgtatgatagaaagcaaagaactgcctgatggaatggttacctgcaataaccgtaccagtatcgggtttattaaagccatgatagagagcggtattaccattggaagtgatattgcagttgtgggaattgacaatgtccccatgctggatgtgctggggtttccattcagctgtgtatccagggataccattgagatggggcgcatgagcatgaaactacttatggaacggatgaataagccggatgtacaaagaagtatttgggtggccccctgcaagttagagctgaatggctcggaaaaaacaaaccggtaaagtttgttttttttaccagatgtgggagcggttccacattcaaaatacatcgtatatgcacgggagagacgtcatcccggatatataaataaaactatattatgaatgagagggatttattatgaagaaacgagttttagcaatgatgatggcagtcaccatggcaggaacgctgactgcatgtagcggaagttcatcaacaaagtccacggaagcggcccaggccgcgaccacaacggcagcaacaacggcagcagaaagtgaaaaaccagcagaaccagaggcaaaatcaggtccttataaagtaacggttattatcaaagcaacagattcttcctattggcagacggtattgcttggagcgcaggcagcagcagctgagagcaatggagagattgaagtgaccactgcaggtcctgcatctgagacaggaattgatgagcaggttacgattctggaaaatgccatatctgcaaaaccggatggtatagtcattgcttccatcagctccgaggcaacggttccggcggtggaggaagcagtagcagcaggaataccggttgtaactgttgacaataaattagcaacagatgtttatacccagcatctggcaactgaccattatgcagcggcatctactgctgcagagaaaatggtggagcagtggaaagaagcaggagtagatccgtctggtaaaaaggttgcagtgatcagtgcggactccggttctgccgtaaaccaggctcgttgtgagggatttgcagataaggtgaaagaactggttccagacattacaatgatcgagacccagtattgtgacaatgatattgcaaaagcacaggatgcggtagacaatctgattctcgctaaccaggacttgattggaattttcggagataataaccacatgggagacggcattgcaaattccattgcacagaatgaaaagtccggaagtatcattgcttatgcatttgattccgatgacacggaaatcgaagcaattaaaagcggagcattgaccggcatcgttgttcaggatccatacggaatgggatatgaaggggtacgttccgtcattgtatcgttaaaaggcaagagcgttgagcatgatgtggtagcggctacgactttggtaaccaaagacaatttggacgtgccggaagtgcagaagctgctgtacccaggtaaataataaatgtcaattggtctgaaatttatggaggttggtaaatgcaggaacaaataacacccattgtctccatgaaaggaattgtaaaggagtttccaggtgtacgcgctctttccggcgtggacctggagctccttccaggagaagtacatgcactggtaggcgagaatggcgcgggcaaatccacaattataaaaatactcatgggagtctataccaagacagagggagaaatctatataaacggtgagaaaaaagatatcaagtccccttttcatgcacagtcattgggcttgggagcggtgtatcaggatgtgaatctggcacagcatctttctgtagctgagaacttctttatggggcagctgcccagaacgaaattcggtaccgtagattatacccgcatgtatagagaaacaaaagaaacactggactctattgaagtgcatgcagacccaaaagcaattatcagaacgctgtcagtggcacagcaggagatggttgcaattggaaagaccatgcatcagaaggcaaaggcggttatctttgatgaaccgacggcattgctgaccgcggatgagacaaaacagctgttccgaatcattgagaagctgaaacaggatggcgtaggggttttgtatatctcacaccgtatggaagaaatattcagtatctgtgacagggcaactgttttaaaggatggatgctttgtgggaaccgttgacatggaaaatacggatgaagaccgcctcatatcaatgatggtgggaagaaacgtaaatgatatgtatcagattgagcacgtacaaccgggtgaaaccatccttaaggtagaaaatatttcaaggggaacagcctttcaaaatatcagctttgaagtgaagcgcggcgagatctttggcatgtttggattggtgggttcagggcggacagaaattgtgagagcgatttttggagccgatgccaaagattcgggaaaagtgacctttatgggaaagccggcagattttaccagaccggttcaggggattcgggccggaatcgcactgctcccggaagacaggagggctcagggcctggcgctgggcatgtcggtggcagacaacaccaatatggtcgcagtgcatcaaatcacccgtctgggaatcatgaataaaggcaagggcgaacgaattgcccagcagtatgcggataaactcagaacaaagacacctacggtttatcagcgggttaagaatctgtccgggggcaatcagcagaaggtggttatatcgaaatggctggcacaggacagtgagttatttatctttgatgagcccacagtgggagttgatgtaggggcaaagcttgaaatctataaagtattcgaatcactgattaaggaaggcaagaccataatcattatatcctcctatcttccggaggtaatggggcttgcaaacaggatgatggtgatgtatgaaggacgtcagatgggaattatttcccgtgaagagtttaccgatgaaaacatcatgcggtatgcttctggtatgaaaggaaaggagtcataaagactatggcggaaaagaaaaaacaaaatctgttcctgtcccgttttcagacggagctgctgttggtgggaattttagttgcactgtttttgttctttggtatgaaatcaccggtatttttaaaagtagatacactgatgaagctgttaaagcaggcttccatctatgggatcatagcaatcggaatgacctttgttattacgtcctcaggtattgacttgtctgttggctcagtcgtgggtttatcaggaattgtagtttccatgtgcatggtaaatggaatcccggtccttgtctcaatcctgatagccataggagcaagtatattagttggattgtttaacggagtcctggtacataatgcaaaagttccgccgtttattgccaccatggcatccatgacggttgtcagaaatgtgatcctgttgatgacaggggccaaaaccatatccaaccttccccggggctttacggcatttgcatcaggctctgtattgggaattcccaatatgtttctgacctggctggcaattattacccttggtatattcatcacaggaagaactgtgtttggaagaaatatctatgcttatggaagtaataaagaatctgcaagattaagcggaatcaatatttcctcaacggtatatggagtgtatatattctctgcgattgtatgcggaattgcaggcattctgatggcggcccgccttggcaatggggtgccgacttccggtgttggatatgagcttgatgcaatcgctgcttctgttgtgggcggtgcgagtttggatggcggagaaggttccgtaattggtaccgtgcttggcgccatgattatggcgacgctgcgtcagggcggaacattgcttgggatcaattcgtttatcatggaaattataataggctcgttaattgcaattgcagtggtgatcgataaaatgcggaaaagctgatagatggagggaaaggctatgatatataagaaggttggaaaaattgcggaaaaaatttcagtaattggaattgggtgctggaattttggaggcgattgggattccatggatgacaggaaatcatcacggattattcatgcggcaattgagatgggtgtaaatttcttcgatgtggccccggtttatggctgggggcattcggaaatggttctgggagcagcacttaaggaaggcggttacagagataaggtgctgattgcttccaaaggcggcctgctatggaatgagaagcatgagacaacaaataatctctcaaaagcaagcctgctgaaagagattgatgagacattgaccaggcttcagactgaccatgtggatatctatcagatgcattggcctgatcccaatgtgccattggaggagacggcggaagccctggaagaaatgaaaagggccggaaaaatccgttatgtaggtttgagtaatttttcacaggcagatgtagagaaaatgatggaatacacagaggtacattgccagcagagcctttacaatatgctggaacggaatacagacagttatcacagcattcctttggaatataagacggaaaaagaagtactgcccaatgtaagaaagtatggtcaggcatttttgccctacagcccattgttccagggtctgctggccgggaaatttcattcagggtcaaatttctctgaaaatgatatcagaaatgcaaatcccaagctggcggggccggcgttccggcagtattttgatggtgcagaacagatcaagaagattgcagaggaatatggaagaccaatgaatgaggttgcactgaactggctgagacagaaagaggaggttacttccattattggaggagcttctacggtagagcagctggagcagaatattcaatgtacggcctgggatattgatgatgaaatgatggcaaagattaatatagtactggaaccatttgagaacttgtaaggaaatgccataaaacagcagagttatgtttttagtaatatatatatagaagtgtcaacctggagcggtggtcttgaaagaaattttctaaagactgctgctttttttatggatttgacggactcctttcttccggcatggaagcctgattgagcctgaatgagagctggctataaaaaagcagaaaaggtcagtattaaactgaaacgtacattgtaaagtcacattactttagggtataaagagaacggattatacaatattggcacaaaaatatatcatattctgaaatgggaaggaaagaaagcttatgcgtaaagaacaggaaagtccatggatcggccaggctgttttacaggtcatggaaaagatggagtgggtcagtgaaaagtcaaaaaataaaatcccctataccacagtaaacggtgttcatgacgataggagtaaaggcagtgaattcgccggtgatgatgggatcaactggtggtgcaatggtttttggggcggaatgatgtggcagatgtaccataagacaggtgaggaacgatatatggagattgcccggatttcagaggaaaagctggatcagtgttttgaggattattacgggcttcatcatgatgtgggctttatgtaccttcctacggctgtggcagattaccgcctcaccgggaatcaggaatccagaaaaagagggcttcatgctgcaaatctgctggcagggcggtttaatcctgccggccgttttatacgggcctggaatgatataccgggaagcagtgatgatacaagaggctgggcgattattgactgtctttttaatattcccctgctttactgggcaagtgaagaaacaaaagatcccaggttcaaacagattgccatgctccatgcggacacggttatggagcattttgtgaggggagacggctcggtatgccatattgtggagtttgatcctttgacaggagaacgggtaagggattacggaggacagggctatgagacaggatcttcctggacaagaggccaggcatggggactttacggatttcttatgagcttttgtcatacagggaaacaggaataccttgatactgcaaaaaagattgcccattactttatggcagccatcccggaagacggcatcatcccggtggactttcgccagccaaagaagcctgcatggtgtgacgacacagcggcggcaattgcagcctgcggtctgatcgaaataggcagacaagccggagagctggaacaggagatgtatcttaaggcggcagaaaggctgttaagggctttgtatgaacatcactgtgatttcaccaaagaaaatgattccattctccagaaaggaaccggttcctaccacagccaggaacatgaatttcccattatatacggagattactttttcatggaagggttgtttaagctgaaaggccaggattttttcctatggtgatacgttcctgtagtgggagcggtactggctgggagtcatgtttttatatttcttaaactgccgcataaagtgaaattcactttcatatccgcaaaaacctgccagggactgaatggacatttccgtggtccgcagatagaaacaggcattttttaaacgggcagatattacatcctgcatgcaggaggtcccgaaaagctccttataaagatgctgaaagtaagaggggctcatatgaactgactgggacatggtttcaatggtccatttcctgtgaggggcatttaaaatggatacccgaaggctgttcatgatcccgtagtatttatgggaagccgctttgtccggtttttcatggatctgggaagaaagggtgaaaaggagagtcctcataagggaatccaggatctgtgcccggtaagggtgagaggaatgcttttccattacaatcagcctgctgtattcggaaagctgccctgcatcagataaggttaccggggtttgaaaggggatttttaaatccataagaaagggaagatcctcttcagccagatcaaagtggatccagtcatcattataatccggcgtgtggcagccgtaatgaacataagcatatttgtcataaagaatcaccgtattggcagggagattcctgtaaatatggccgcattcaaaaaaggcttcggatttgaccacaagaagggtatagtcgggagagccttccgggcgaagcatgtgaaagggtttctgatgtcttgattcataaccgcagttcaggattgaaatcatctgctggctccttttcatgagatagccttattataccgcctttttacataggtgggaagccggaactaaaattttaactgaatcaggcagcaaagcggactgggaatgtctgcctggagaacagaaaggagaatatggctgcagctggtttacactcagccataaaacagatatggagcagattgtaaatggaatctggaaattggtattgggagaaccggaagaaaagacaccggtatcctttcagatggtacctatgaaaacggaggcaattcacagcctccctgtacggagaaaagcaccggatatctgcagggagatccggtttgaagtgaccgtccggggaatcacggtgacacttcccatggaaactgatgaggatatttatggttttggcctgcagttaaagagcatgaaccatggaggaagaaaaagaaggatcagggtgaattccgatccgccgggagatacgggagaaagccatgcaccggcgcctttttatgtttccactgccgggtacggcctgtttgccgacacgttccgctatggggatttttatatggggaccaattccccaaagggagcatcagccggtaaagcagaggtgaacgaaaagcacgaggaattttcggaatcagccctgtatgcattgaaacgggcaaaagagaagcgtgcaatcataattgacattccccatgtaaaaggcattaccctgtacctttttgccggagagctgttagaagtggtacagcgctacaatttattttccggagggggatgccttccgcccatgtgggggcttggggtgtggtaccgggcctatgggggaagcaaccaggaaaaaatccttgacatagcaggcgggctgcggaaagacgggatccctgtagatgtgctgggacttgaaccaggctggcagtcacacagctattcctgcacctatgcatggtcatccctgtttcctgagcctgaccggatgatcagtcagctggcggatctgggctataagccaaattgctgggaacatgcttttgtatatccggcatcggaaatttatgaaaagcttctgccattcagcggcgattacgaggtgtggaatggccttgttccggactttgccatgaaggaggcccgtgaaatattcggcggctaccatgagcgggagctggtggataaggggatccttggttttaagcttgatgaatgcgataattcggattataacccgtccaactggtcattcccggattcctcccggtttccgtcaggcatggacggagagcagatgcacaatgggatcggttttctctatcagaccatgattcttgaactatttcaaaaaaagaatctgcggaccctttcccagacaagatcctcaggagccttaagtgccccccttccttttgtcctgtactctgatctttacgatcacagggattttatcagaggaatggtgacctctggattttgcgggatgctctggtcccctgaggtgcgaagctgtgagaatccggaggaccttttgcgaagagtggaaactgtagtattctcagcccaggcccttcttaactgctggaggattccaagccctctctggaatcaggttgacgtggaaaagaatttaaatggggaaaaaatggaccgctgggagtattatacggaggtttgcagaggctatttaaacctgcgcatgagcctgctcccttacctttacagtgcatttatgacctatcacagggaagggattcctcctgtcagagcggtggttttggattttccggaagattcccgggcagcagtccttgacgaccagtatctgtttggagaaagtcttatgatatgccctcttaccataaaagacggaaccattcggaaggtctggcttccggatggaatatggcatgatttctttaccggggaaatgataaaaggcgggcaggagtaccaggttcatgctgattatgaccagataccggtttacgtaaaggacggggctctgattccttatgcccagccagtggagtgcgtcagagaggatacggtatttaaaatccatgtccgttcttatggaaagggaagatcatcatttcctttgtatgaaggagatttccagaccttttcagatgaaaacagtgatgataagattgtaataataagagatgagaacggcaagatctcatgggaacggcatggcggcggcagctcccggtatgagtccgcagaaggcattcccatcacaagcagctgagaaagaaggttcctatgaaagtgaataatcccatacttagaggttttcacccggatccgtcgatgatccgggtggaggatgattattatattgccacttccacctttgaatggtggcccggagtacgcctccatcattccaaggatctgattcactgggagctgatgccttatcccctaaacgatccttccaggctggatttaaggggagtagggccttcccagggaatctgggcgccctgcctgacttatgacaaagggaccttttatctggtttataccgttgtcacggccttttactgtaacatgtacgataccgccaattatctggtgactgcagaggatatttccgggccatggtccgatcctgtacctcttaataatttcggatttgacccatccctgtttcatgacgatgacggaaaaaaatatatcgtgagtatggtaacggatcaccggattccccctaaatataaaggcaggctggttttgcaggaatatgatccggcagaaaagaagataacaggtgagataagggatatatatcaggcggaaaaaatatttctggaaggcccccacatattgaaacgggccgggtggtattatctctttagcgcagataccggcacaggcgaaggacatggccagaccatacaaaggtcccggtctgtttgggggccttatgagatgtaccagcctccttacggcagccgttcttctgaagatgaggcctgttccattctcactgcccgccatgatcctgatttccttcttcagaaatccggtcattgtgatctggtagagacagagcagggggaatggtacgcggtccatttatgcgggcgggcgctggaacggaggaatgcaccggacgcgcctaagtttcccggaagccgcagatatcctctgggcagggagactgccatacagaggatggaatggacggctgacggatggcttcgcctggcaaacaacaccacgctgccggatattgaatttgatatcggcgccccccttcctggacctggataaaacctctggtacgggatgaatttgacagcccggtccttaacctggaatatcagtctttgagagtccccatggatgagacccacatttccctgacagagcgtcccgggtatctgcgcatgtatggcagggagggactggcttcccgttatcaccagaccttgatagccagacgatttacagagtttaatttccaggtatcagcatcaatggaatttgaaccccaggtatttaagcagatggcagggctcattcttctgtatgatgaccagaattatttttatctccatgtgacctttgatgaagatctggggaaatgcatcagcattctgacggctgagaataaaaaataccaatacccggtgggattcatgcccattgaaaaagacagggagatatttttaaaggcagaggtccacaaggaaagactgcagttttattggggatatggagaggagcagtggacggccattggccctgttttagatgtttccattctttctgatgaagcatgccgggaaggctggtttaccggcgctatggcagggatctgctgccaggacttaaccggattccgaaaatatgctgattttgactggtttgaatataaaacctgcaatcatctataaaaaccgtactaacatcttaaaaaatcatgttttccatccattccgttcctgatatagtaagggagtaagaaacaggaacggaaaacaaggaggagaaagctatgaggaaacaaataattgcatccatattatgtgcctgtatggcggggaccatgctggccgggtgcagcgggaattctgcttccggtaccgctggggcagatactgcggcaccccagggcgaagtaaaaacagaggcagcatcttcagaggcagaccagaaggcttccatcgttacggcgccgacagagctgacgttcattttcgcagacggagacgagggagccaaggcatccatgaatgaaacggtaaaccggtttaataaagcttatccggatattaccgtgaaaattcagccaggaaacggcggggcttacagtgagtttttaaagacaaaggaaagtgtgggagaatttccggatgttatggaaatgagggatactccggtgtatgtgcgtgcaggaatgctggaacctctcccggagacgattgtgtctctgtttaagagtacggtaacttttgacggtaaaacctatacggctccccttgcaggagaaaatactcagggaattatttataacaaaaagtattttgatgaaaacggatttgcggagccgaaaacatatgatgaatttctggagctttgccagaggatcaaagacaaaggggatatgtctcccctggtgatcggcggccaggacatctggcacataggcttctggttctataaagcgtataatgatcaggtattaagccaggatcaggacttcatcaaacactgctatgaaggtacaaagaatttttcagatccagccattggggcaacctttgaagaactccagaagatattccagtacgcacaggacggatgggtgtcaactcctgatgcgcagatcaccacatttctggtgagcaatatgtctgccatgatgtattccggcacccatatgttttcccagatcacggctgctgatcctgattttgaaaccggctggttcccggttcccagccccgacggaaaaacccgtctggtaggcggaggcggagcaggaggacttgcgatttctgcggaatcggctaaggatcctaataaaaaggctgcggcagaagaatttatccgtttcttttaccagccggaaaattacaaggtttactgtgataagctgaatgccattccctccacaaaggcaatccccgagcttgatgcggcgcctgttatgatggaagtcattgacgcgaccaattcggcagatgatttaagcgtgatgtggaacggacgcatcggagataacgagcttcctcctgatttcagaaactttatgtacaaaacaaccattgaagtgattcaaggacagcgcgacatcccttccgcatgtgaggaattgaataaaacctggcaggtggcgatgcagagctttaatcctgtgaaagacgccaagtaatcagtgagaatggggctgtttcaaaaacgcaaagtttttggaacagccctttataaaagaagtgactacaggaaaggagatgaaaaagatgataaggaagaagaaatccgggatggactttgtaacggtgagctttattgcaccggcgtttttgttctttaccctgtttatcattgcaccgaccatcgcaagtgtctattacagctttacttcatgggatggcttgaatccggtggttcattttgtggggctgtctaattataaggagatattcaccagtgcccgttttggaaatgccctgaaaaacaccattttgctgactgcttttatctcggtgcttgaaaatgccatggcacttatgctggcattgatcgtggatcatgtgaaatgggggaaaaactttttccgcagcgccttttatgtgccggtcctgatcagcggcatcgtatccggttttatatggaagatcatgtacaattataatttcggcgcagtcaacaccatattaaaggagatgggtatggggcagtttaccagggactggctgggaaatccgggtctggcactgatcatggtaggtgtggtactggtatggaagggcgccgggtattatatgatcatctatcttgcgtccttacagagcgtgccgacagacgttgtggaggccgcggccattgacggagcctctcccatgcagcggttccgggccattacccttccccttatttcgggagcatttaccattaattttaccctttcccttattaacggcttaaaggtatttgaccagatttccgtgatgacagacggaggtcccggctttaccacggaaactatcgtataccttctctataaagtaggctttaacgaaggacggcagggctttggaaccgcagtaggaattgttcttttattcctcatactgattttaaatgcgatccagcaatccatcctgaagaaaagggaggtgcagctgtagtgagagaagcaagtgtcttatctggcagaaagaagcaaaaaccggcgccttatgttttactggctgttaccgtgattttggcagcgctttttttagcacctgttttctttgccttgatctctgcatttaaaagcaatggcgagatcttaaaaaaccccatgtcccttccggccaccctctatttgaaaaattttcaggacttatttgcccagtctgattttctcacggctattaaacacagtgtgatcctgacagtggtttcggaggtattgattgtatgcatcgtccccatggcggcctatgccatggagcggcggcagaccagggtgacaaagctgatttacatgtattttctggccggaatgatgatcccttttcatctttatatgttccctctctttaaggagatgaaaatgttcggtatatttggcactctggcaggccctgttgtctgctacttatccggttccgtggcatttggaagtcttttgtactgcagctttttaaaaggagtacctttagagatcgaagaagctgccgagattgacggctgcagtccttttcagaccttctggcaggtcacttttccgctcctcgggccatgtacggcttccatggtggtattaaacgggctggggatctggaacgactttttaatgccttatctggcacttccttctgacaaggcgaaaaccataaccgttgaagtgtattcctttgtggggcagtatacggcaagatgggatattgtttttgcaggaacggtttgctccatcgtacctgcgctgattatctttatcatgctgcagaaatattttgtaaaggggatcaccgctggggctgcaaagggctgagtttctgcaaggcaaaagtgtaataaattgtaaaacaaaattttccgtgataaactggtggtataaaatccggcggatcgaaggtgtggaattccatgccttcgattttggcgcattgtaagaataagaggtggaacatgaagatatggaataaaaagctaaatttataccagaaattcagcatggtcatccttttgcttggcctgcttcccatgcttattttatccaccgtgatcatgaaccggatgttccgggaatacggagaatcccttcggaacaactatgaacaggcggcgggctatgtaaatgattccattggggatatgtttgaaacctataacggaatcgccaaaatgccttattattataattattccagtgaaggacagtttgaatttaattacatgtcctttgacaatctgcgccagatcatttatgggatcggagttgagcctgaaaaggtggaagagatcagaaggaataatatgcggatattcttaagcaatgtccaggcagtggataattctattacaggaacccatttcattgccagggatttagacggtaatattctgcccttccataaatccagaacaggccttcaaaatcccaaagatgaaactgtttttaacgagaggatgggatttggcagcctggataaaaacagcaagaagttccttctgattccctctcataaaaatgattatttccccatgcatgatgaacaggtatttaccgttgccagaaactactttgacttaacaggggtggtgggaaattaccattatgtgggaaccctgttccttgatgtgtctgtgtcaaggcttgaggaagcgttccggaacatcaatctgaatccggaagacagtgtttttgtatgtgaccgggattttaactgctattacagcagcgatgcagacttaatcggtacggatctttcaaagaaaaaggggatattaaaagaaacggaagaaaagtttgtcattgaaacggactataattcctacggcttacaggtgatcatcaccatgaaaacaagaaccgtataccagaagctgaggcagatgcagcacatgatgtatctttttcttggtatctctcttgctgcgctgatgtgcggctctctctggttttccagacgcttaaccaagcccatctatcatatgatggaccggatgtcggagattgaaaccggtaactttaaagtagagcttcccgtgacttcgggagatgaaatcgggatcttatccaaacggttcaaccagatgtcaaaggaactggaaaattacattaatcagtcttatgttgcccatatgaaacaggcggaagcggagatgacagccttaaaatcccagatatatcctcactttttatacaacaccctggaagtgatccggatgacggctcttgaacaggaagattctgtggtttccgaaatgatcgaggctttgtccacccagatccgctacatgatcggccccatgcaggatatggtgcctttggagcaggaagtggatatcatccgtaaatatgtttatctgctgaactgccggatcaagggaaaggtgaagctggtggtggaattaaacggactcggcgggcagggagttcccaagctgattcttcagcccatagtggaaaatgcctttgtccatgggatcaaaccaaaggatggaagcggaaacgtattgatcagcgcagagctttcggaaggcctgctggaaatatcggtcatggacaatggagtgggaatggatgaagacgctcttatgagacttcggactcttcttcttggaaatgaaccgggaatcaaaaatgagcacaactggcagagtatcggattaaagaacgttcatgaccgcatccggtatttatttggggaaggatatgggattgaagtgacgagcacaccgtcggttggtaccatggtgagaatcattatgccatggaagaaggggaggaagaagatgtttcgaatgattctggcagatgatgaaccggtgatcacaaaggggattaaaaaactggtggactggaaagggcttggaatagaaataacaggggaatacgaggacggaaaggcagctcttgacggaattataagagagcagccggacatggctcttctggatatccatatgccgaaaaaaagcggaattgatattttaaaagagttaaaacagttaggaatcagtaccagggtgatttttatcagcggtttccaggattttcagtatgcaaaggatgcgcttacctatggggcggtggactaccttttaaagccgattattaaagatgaactggtaaacaccattgaaaaatgcctgatcagcatgaaaagggatacccttttgtttaagacagaggaaggaaaaggggatgagcagatggaatttccctctccttcctacaacaagctggtggaagtggaggaatgcaaataccttccggtggtagcggaggtggtttgtgataggtccgtaagccttcaggagcagaagctgatccggttttccgcaatcagctttctggaggatttccttatggaaagaaaccagggaattgtatttgtcaaaaaccggaatatggtaatggtcataaaaaatccggatcagtgccagatcggagatcttctttgggagatcatggaagaggcggaccaggccatgaaatgcagactggctttcattgtgggagaaccggtggattccatgggagaaattccggcggcttatgaaaagtgcctttccatggagggctatttctattttgcaggccagtttcacatcccggttttccggtggggaggtcctgtttttaaaaagaaggtgtccttagaggatatccgggaaggcagagcgaagctgatggatgccatggttgcgcaggatgaaaaaggatttacgatggcctgtgaacagttcaaacggctggtcagcattgcggcggatgggagaaaggaggatgcctgttttcactatgccagcaccatccgtattctggaagaacggtttgacacccttggaattaaggggcctgaactggattttaaagaaatcctggatttgtcaagaaagaccgttggatacggggaactggcggaacagtttttgcagtatttcatccaatacaaagaggagatcaggcaggccgtggcaaggggagataaaaaggatatcattcatgccagggaatatatcgaaaagcattacatggagaatttgacactggaggtgctggcgggtgaggttcacatgaacccctattatttcagcagtttctttaaaaagagttcaggggaaaactttaaggattatttaaataaggttcgaatgaaacacggagtatccctgctggtttccactgataaaaagacagcggaaatcgcccgggaaacagggtttcgggatcaccgtgcttttgcggagctgttccatcgcttttatggggaaacgcccacctcttaccggaaaagaatccgggagaagggggattttcgtgcttgattgaaagaaaacgcacgttggaatattatacaaatcatgtgcagtgtatggctatgctcaattgtaaatcgaaatgcaacccttccgattccagattgagataaaatttataaattagatatagataccagaaggttgcattctggcttacaaaaatgattgatgttctttcattgaatgttgagattaccagtcttttccgtttccttagattgcttgattcctatatcctaaaagagttggcggcagaacggaggatattggatgtctaaatttttacttacgaagacaggctcagcctgcaaaaatatcttaaagattctttgtcatttatggagatcgcacgccgcatggataaaaatccaactaccatctccagagaagtgcgtaaatacagctcgcacattgccactggttatcccgggtttcctttcaatgcctgtaaaagcagattcaattgccggaagaaaaaaatctgtggaaaagaatgtactcgtaaatcagatagctactgtaagctgtgccagtcctgtaatgcgaattgcacagacttccttgaagaaatctgtatggcaagatttcgggcaccctatgtctgcaatggttgccaaaccattggtaagtgcactcttctgaaaactgtttatgatgcagagcatgctcacatccacgcacatgagaagatttctgcctcaaggagcggtctttgtgtttcagaaggggaaattagcagactcaatcatatcattacgcctctcgtggaacagggacaatcggtcaaccagatctatatcaatcatcaggatgaactgatgtgcagtgaaaagacaatctataactacattgatgcatgtttgtttgacattagaaacattgatttgccaaggaaagtaaagttccgagagcgatacaaaaagccggaattcaaagttgataaaggctgccggatcaaccgcaattataaaaatttctgtgagttccttgagaaatctcctgacgcgaaccttgtacaaatggactctgtcatcggagaaaaaggaggcaaatgccttcttaccctccactttgtggagtgcagctttatgcttgcttttttacgtgatgcgaatacttcaaaatcagtaaccgttatttttgataacctgcatcagacactggagcatgagctgtttaaaaagctgtttccagtgattctgaccgacaatggaagtgaattctcaaatccgaaagcaattgagtatggaccagaccttttctccggcttaaggaccagagtattttattgtgatgctggaagtccataccaaaagggtgcgatcgaagtaaatcatgaactgatacgcagagtccttcccaaaggaacaagctttaacaatcttacacaggatgatatcagcttgatgatgaatcacattaattcttataaaagaaaaaagctgaacaatcgtagtccctacgaaaccttcagcttttatcatggagaagaggttttactaaaacttggatgtaatccggttgcccccggagacatcatgctaaaacctgttctactcaaaaaataataaatttgcatgccgccaacgtctaatctgtctaaggaattaggggtggattctccgattacaaaaaaatcgagagggaattgacctcccttaggcatacgcatttttattatcatacaacaataaaagcaaaaaatcaaactgcatttcagtcacaaaggtgtcttctggtttacaaagcatgcatttcgagtacaaaagtggcttttcggttacaaatattcaattgtcatttacaaagatggcttttcgaattacaaagtggcatctcatcttgcatttgagtgctatatctgcttcctggattgttttacaaaaaataattgtaaaatttcgatatttatttattgacaaacgataaaattgtgctataatcaaattgtcaataaatagtagaggtgattttatgaaacaacggattccaacaatttttctaaagatggtgataggttttatcggaattgctgcacttgctttttgcgtatttctgctccctttgtttgcaaatgaaatggcggtaataatgccggaatgggcatttctcaagtatccattcctcatatgcatgtacgtaacaatgataatttttctcgttgcattataccaggccataaggctgatcggctatattgacaagggagaggttttttctgagttatctataaaatcattaaaaaacatgaaaatatcgggaataatgatgactgtccttttatacttatccggtatgccggtcgtatatgctgaggctcaaatcgaagatgccccggcctcgtaattatcgggtttgccattgcttcaatcccccttgtagttgcaacctttgtggctgttcttcaaaggctcctgcaagaagctttagagataaagtcagaaaatgattttacggtttgaggtgagtacatggcgattataataaatattgatgtgatgctggcaaaaagaaaaatgagtgtaacagaactatctgaaagagttgggataacattggcaaatctttccctgctcaaaaatggtaaagtaaaagcgatccgattatcaaccttagaaggaatttgcgaagctttggactgtcaaccgggagatttgttagaatataaaaagtctgagatatcgcaggctgaaattgactgaaagcagatatttccgcctcctgttataaaagcttttttctgcctgtcatgcataaaaaaaggccgctagttggcatatggtttcttgcgggccaataatagaaaatataacaaacgacggttgttgaaaccgtcgtttttgccgttttcgctgtaccggaagcagctactgcgcaacaaaatccaccaattccgaaatatggctgatagaatgggcactttgcttaatattgccgtatccataggaggcaaagataaaaggaatgcctgccatggttgcggaatcgtaatcaccggctgtatcacctacataaacggctttttgtattccattacgttccatgagaaggctgatattttccgccttgtttttcccattattgccaaaacactctatatcagtgatatacggttccaggccatacttttttaaaaacatttcaatatagccggattgacagttgctgacaatgtagagacggcaatattgcgacaattgttcaagggcttctctgactccgggatacagcatgtcacagtctgcctcatccagacagacagtattaaagcagtcgcattgatccataagctcatttctggtatctttatcaaactcaggaaacagttcatcagcaatggtactgatggttttgccaaattcctgcttaatcacatccggtgtgatgtggagagcgcttctgccgtctttctggagcgcccggttataggccatggcagatagttcagtggtattccacagcgttccatccaaatcaaaaattatatgttttatatccatgatcacattcccctttctttttttctttgttaagattataataataaaagatatgattttggtcaatatatggcggtaaaattgaaaaatgagcacaaatgagcaaccttgggagaaaatgagtaaaagtcagcgggaagaagagatattggagattctaaaattgaataattatgccactgtggattatttggcggagaagctttttatcagcccatccagcatacggcgggatctgtccaatttagagagcaagggatatgtgcggcgttcctacggaggagtaaccttgatttcccagccggcaacgatagcgcctttctctttccgcaggcaggaaaaccggaaagaaaagatggccattgtcaaaaatgccgtaaaacttattactccggattcttccatattcattgacagttccactactgctctgaattttgcttttttgttgaatccgtctttaaataccaccgtttataccaacaatatgcagctggctcaccatctggcttccaagcatattaagacctatgcggccggcgggcttgtatcagattttgataatgtggtgacgactggatcctacactctggggatgctagagaatatttatgttgatcagatgttttttacctgtacggcacttagtccgggcggacagattatggatgtaaatgaggaagaaacggttgtccgcaagtttatgctggcacgggctcaaaaacgggtatttctttgtatcaaagagcggttcgggcaattctcacagcatatggctgccacgcttgatgatgtggaatacgttgtgtccgatgaaaaactgcctgatgagtttacggaaaaatttaaacatgtccattttatcagttcagataacaatgggagtacggaaaggggagaaaccgttgattatccagcgacagattgaaatcttattggagttatgcaaagaatcggacagatttctgacagcagcttatttttcaaaaaagatgaatgtcagcctgcggacagttcagggggatttaaaggtgataaaggaagtcctggctaaggaaggttccgccagcatcatttctgcagtttccaagggtacatgtttacatattgaaaaccatgaggaatttaccgcttttttaaacagcctttaccagcagcaggcccatgtttccctggcctatccttccaaccgggttttgcagatcagcatatatttattaaaccagcatcgttcggtttccattaacacagtagcggatgaattttttatttctgcctccaccctgcataatgatatgaaaaaactccaggaactcctggaagagtttgagctggatcttttgaaaaatgataacaggattctcattttcggatcagagataaacaaacgcagatatattgtggagaaaaatgtgtttctcactcatacgcccggcggttttggaattgattatgtagatgaaaagcagattcccatcatcaagaatctgctgacagaggttttgattaaatacaaatacagcgtggctgatgcggaaatccagaatgccatcctgtttctgaacattatggtaaaacggcttcaaaaaggattctatatcagtcccagtgagctgaatataacagacagcctggatgtggaagaagagattgccagagatatttttgagcgtttaaagaagcgctatctgatcaatgtcacggattatgagaccaattattttgccctgtatctgaaaggaaaatccaattgtcagagcacttcaatggtcaccctggaaatggatgcatttatacggaaggcatttctggaaataaaaaaccgctttggtattgattttaccgacaacatcaatctcaggatcgcccttgcactccactgtgtgcccttaagcatacggcttaaatataatatgcagctgaaaagcaatatgctggattatattaagcagacctttcctttgggatatgacatcggaatttatttttctcttttactggaggaacggtacggcagcaaaatgtcggaagcagaaatttctttaatcgcggtgcacttttacagctgccttctggaggagagctataaaaccgggatcaagcaggtgctggtcatttcttccctgaagaacagcatgaccttactgctgagacagacgcttttaaaatggttttccggcaatatatccaagttggaatttatgaacgaggttgaggtgactgatgatacgctggaccgttttgatgtgtttctcaccactgagaaaggcaggatgtatgaaaacggcatggccatgttcattaacatctttccggacaaccacgattatatgaatatcaagctgatcatggatggatttaaaaatgtggaaagcattttggaaattttcagcaaggaccttttctttgtcaataatggaaggacgaaagacgaaattttgaaaaatctctgtgaacaggcaaattccaagttcggattggaggccttatatgaagaggtgataaaacgggaagagcggggaagcacctattttgcagaaggcattgcagttcctcatccaatgtatgcggtgtcctcggataccttttctgccgtatcagttgttacagagcctttgacatgggatggggagcagaatcaggtacatctggttgtaatggtatgtatcggtaagaacaatcctcaggcgttccaattatgggattacattgccagaatatttgcagataaatcctttgcaagcaggcttttggagaagccggactatgagacgtttgtggccattgtgaaagaatcgttaaaagataaaattcagtaatactccataaaaaacaccttccggcaaagggaacagccggaaggtgttttttatggaaaaaagcagcttgttactgattaataacagtggtaatgctttcaaccgccttacttacatgatcaacggcttctaaactgagctcgatcacactggcaatttggtgatcactttcgtaggccttgccaaaggtctggacaaaagcccgccttaaatcagaaccatagttgactttcagcatcttataattcttcatttgacggatgacggcaaagtctacgccggatcctccgtgcataaccatggggaccgggcataaggcagataattcttttaacagcggaaggtcgatgtttggcgtcatttccagtccatggacatttccgatggatacggcaagcagatcacagccggtccgggtgacaaagtcttctaccagagccggatcggtcttgcagtcggattcgttgataatgtcttcttccttccctgtaaagcgccaagctctgcctccaccgggactccgtaaaaatgacaatattcgaccgcgcgccgggtttccttgatgttatcttcgtaaggcatgtgggaagcatcgatcataatagaagtgaagccggcattgacacagctctttacatcttcataagtcttgccgtgatccaaatgcagtgcaacgggcatatccgaatcctttaaagcatcctttgtcagggtcacaatcgcctcagggctggaaagccgaaggttattggaagaaatttgtatgtatcccggaaaccctgcactgttaagtcccttagcgatggcataagtcatttccatatttgtggtgttaaatgacggaagcaggtatttgtgccgtaccgcgtaatccataagatcatatccgtttgcaattttcataaaaactcctcctttttaataatttctgtttctttgagtataacaagggggaggcttctgtgaatgtatcctattgccatattcattgcgcaattttggcttaagacgaaataacaaaagtgcatgatctttacgaaaaacgttgtgtgagacccttcaacgatcatgctatactttttctaaacttggagttgtacataaaaacacagggaggtttgcgtatgaagataattttagtatctcatggatacttttcaaaagggttgttggaaagcgtccagatgattttgggtgaacaggaaaacctgacggctcattgcctgatgccggaggaaacgccggcagctctgtcgcagcggttagaggcagagatacgagaaacggaaggtgatgacatcctgtttttaacggacctgtatcatggaagtccatttaatgtagtggtttcccttatgaaagattataaattccgccatatcacaggaatcaatatgccgctgttgatcgatgcgatcatgagcaggaatgggggtctttcgattcaggaaatctgcagccgccttgtgaaacaggcgccgggaaccatcctggatgtagatgatttgctaaagaaggaggacatggaagaatgagaaatgttgtattggcaagggtcgatgacagattgatccatggagaagtggtttctgtgtgggcgcccagtttaagcgtaaacaggatcgtgatcgcagatgacggagtcgcagcagacaaatttaacagcagagtgttaaaggcgctggccccagcaggagtaaaggtaaatgtatactccgttgactctgccggagaaaagctgaaagaggatgagataaaaggggaacgcatcatggtacttgccaagtcacccattacctttcagcggctggttgacaagggtgttttaatcagggaagtgaacctaggcggcatgggattgcgggatgagaggataccatttattaaaaatgtatctgccagtccggctgaaatggaagccatgaaggacatgcggtcaaaaaacgtaagggtatattatcagcttgttcctgagcagcagataatagaagcagatgactatctaaaataaaagggggaatttttatggcaatcacaatgtttcaggcagttttattggggatcgtttactggctggcaatcggaaacctgccgtttgtaggcctttggtcattgcagagaccgctggtctgcggtatggtaacgggatttattctgggagatccggttcagggcgccgtggtgggaggaacgattaacctggtgtatttaggattcatgtcagcaggaggcagcatgccggcggatatggggcttgcgggaatcctggggactgcatatgccattgccggaggcttagatgcgcagacagctcttgctttagcagttcctatcggcattcttggaaccattgtctggtatcttcgtatgacctttgactcggtctttgttcatatggtcgacaggtttattgagaaagggcaatacaataaaatctggcttggaaatgtactgtttcctcagatttttgcattcctgatttgcgtgattccgtgtacgctggcggtttatttcggggcaaattatatccagggtattttgaatcttttaagcggcagtattttgacggtgttccagattatcggcggtttaatgcctgctcttggtattggcatcaccttattgtacatttttaagggagaggcaaaagtgttcttattcattgggtttattctggcagtgtattccggattaggacttttgaccctgggcatcattgccttgttgacggcaattgtatatgttcagataactgatcggaaaatggcagcagcaacggaggaggatgattgatatggcagagaaaaagagtttaattccgcgtaaagcgctgatgcgcgcatggctgatctgggaaacattccctcagacctgctacaattatgaacgaatgatggggcaggtcgtggcccatatgtttgcacctatcatcaaatacttctataaagataacccggaaaagcagaaggaagtaatgaaacgggaagcagaatttttcaatgtacatattgagtttggcgcatgtatcctgggcatggctgtggccatggaagaacagaaggcaatgggagaggacattccggcagagtttatcaccaacatcaagacctctttgatgggaccgttagcaggggtaggtgataccatctggcagggagtcgtcatacctattttactggcaatctgcattgacatcacccgttccggttccggaaacgtctggggctccattatttatgcggttcttatagttggagcggcttatggactcagctatgcgaactttatgttcgggtaccgggcaggcagtgaggcaattatggatttcctggaaaagggaacccttaataagattttaaagggcgcgtcggtcatgggctgtatggtcatgggcggtctgattgtaaactatgttcactgtgtctgcggaattgaaatcgtaagctccacctcaacgtttaatttccagactaactttttcgatacggtcatgcccaatattcttcctttggcagcaaccatgggagtttacggactgttaaagaaacgctggtcctctattaaaattatccttttgatcatcgcagtcggtgttgcctgcggatttacagggatcttaacattttaaccaaatcaagtaagtcccccacttcaaatgcaaaaagcattaagtggtgggtgggacttgcttgtgtcaggtggagtacaggctccccctgactgcccggcaacaataaattttggaaaaccagaaggtgggattatgaaagcaatcgtattggaagaaccaggaaaatcggctatcaaagaggtagagcttccgcctttaaaagaggatgaagtcctgttacggatcgtgacttcaggaatctgtaccaatgatgtccgtgattttaatggagagtgcaattacagctatccgcgcatcggcgggcatgaatactgcggcataatagaggaaaccggaagcaatgtgaacagccgttgtatagtcaagggccagaaggcagttacctatatcattgatgattgtaagatctgctattactgcaaacacggggaggagaatatctgcgaggggcttccccagacaaagacattccagaatccggacggtttatcaggatacggtggttttgctgaatacgtgatctgcaaggcaaatgatgtatttatctatccaaaggatgtctcctttgaaaccatggcgttcactgagcccttagcctgtgtggtcaacagcattcaccggaccgacattcagtttggagatgatgtccttgtcataggagggggcgccatggggctgcttcacgtgatggcggcacgtttaaagggtgcccgggtgattttaagcgaaccattggagcagcgccgcaataaggctcttggcttgggctgtcatgcagtgattgatccaataaatgctgatgcagtacaggaagttaaaaaaataacagagggacgggggcaaggatcgtatttaatacgaccgcatctccggcagtggcaaaacaggcagttgaaatgacggcgcctgggggaacctgtgtgatgttcagttcccttcaccccaatgacccggtacaggtaaatatgggagctgtccattcttatcagatcaccgtcaccggtgcagtcagtccgactataaaagcctaccagcagtccaccctattgcttggaaaagggttattggatccaacacctctgatcgaaggaatttacgattacagggactttgatgctgcaatgaaggctgcggcaaaaacagaaagctacaaagtgcttcttaaattcggagaataatgatggattattttttaggaattgatataggtacatcctcggcaaaattaattgctgtggatgaggccggcaggacagtaaagaggtgtgaacggaattaccggtattcccagccaagtcccggctggagggaaatatggcccggcgtatgggtggatgctgtggaggatggcctggaggaattgcttggggctttggaccggcagcaggtaaaagccattggttttacaggccagatgcatactacggtatttctggataagaaaggaaaatgtatcaggccggccattatgtggaatgatatgcggacaaaagaccgcatatcttccatgaaagatttcattgcaggaaaggaagacacccggtccattttaagaatcctgtcaaccgggagcccggcagccaatctgctgtggctgaaggagcaggagggggagaatttccaaaagcttgacaaattcctgatcggtccggattatctggtatattatttttccggggaatacagcacggattattgcgaagcctccacatcttccctgtacgatacggaaggaacatgctggtctttgaccatgagccgcctgctttctctgcctgagacagcctatccgcctgtcaggggcagccaggagattgtcgggaatcttacaaaagagctgcagaaaaagttcagccttccggccggtgtcagaattatcgccggcacgggagataatccggcagtagcagtggcaacaggggggctgcagtaccgttatccggtgctgtctattggaacctccggtgtattggttttatcccgggataaagtagatcgggagatgaagggaaaacagattttattttcactggatggaaaagaaatccatgtcctggtccagggagttgtccagtccgcaggggggagctataactggtatgtgaaaaatattctgggaatggatgactttgaccgtttaacaaaaacagtaattccggatacacagagggaaaggggcttgttgttttatcctcatctgacgggggataaaaccatttatgctgatcctgaggtccggggcgcctttgtaggattggataccaatcatacaaaagaagatctggcaatagcggttatggagggaatttgttttgccataaagcagctggtacaggaaatgcagctgacttgcggggagctggagcatttaaaggtgaccggcggcggatcttacagcaaaatatggatgcagattctggccgatgtattaaatgtgagcatccagcagcttgacggaggggagggagcctcctacggcgtggcaattatggccagaaatgcggttcttccaaaggaaaaaggggctgtgtgtggacagccggtgaaaatccgtgcctgtttcatgcccagggcttatcaggcgggagcatatgaaataaaatacaaaaaatacttgaagatgtatgacgcactgaaaatgatcaatgagtaaagatggtggtaaaagtgaaagcctgcggtgtgtgtaatcacagcttgggagtggtgagatttaaatataaagatggatttgtttgtcaaaactgttatagagcagccagcagaacctataccgaaacaatccggcacctggatttaaatgaattaaaagcaaggtgcaatagaaacggtgaacaatcggattttgatgattttgaaataacagacagaattggtaactatattctgattgacggcaaacggaaaaaagtctgtgttgtgaataaccggctgcaggtaaaaggatacagaaaaccagaaatcatatcattgactgatatccggtattgcagaatttcctgcggttcttcttttacatgggaagagctgcagaatgatgaaaagcagaaggacggtcatgtgacatccttgagcttagagttcattctaaattcttcaactgattcacagcatatccagatattatcttctccgattagaatcaaaagctttgcatttcggaaatcattggattttatgaagctgattgtagactatctgcaatccaatggagtggaatgtgtatatgcctgattaaaattggtattgggaagggaaggggcaaaatggaggcttttaattttaaggttcgggttccggttggaattcatgtcagaaatgcgcttctgctcagccagaaaacagtgcattaccagagtaatattgcgctccataaaggaaaccgggttgcaaatgcaaagaaactgatggacattatgatcctgagagtcaggtgcggagatgagatcttgtttattatggaagggcctgatgagaaggaaatgctgaatggagtccgggaattttgtgagaagaatttatgattggtttatgatattggaataaggaaactattgttccaaagatacataagctgtggggaagcttatgaaaaaaactttgtcatgggaaacatggaagccgggcttgttccaggagaggggaagcggacgacaatttatattggagtaccctgagaaaaggggaggcagggagaggagcagtccctggataacggaatataaaaactataaatatgaaacagtctggcaggtagcaatctgccaggctgttttatatttgcggttcaagaaataaatttccatactttcatgcaaatgttttattaattcttatggcattgaaatcctgttccatacaacagaaagatgtatttccttctttgtcataagcacgaaccacatatgccctgaccttcctttgtacatgcttcgtagtaaagtgcatggtcatcattggcagagagattgatttaaaaaaagtaaaaatatatagttttactaaaaaaaactaacgagataagaatgaaagttatttagataatttgaacattataattgaaatatatatgaatttgatgtatatattttcgaaattatataattaaaagcatagataaggtgaaaattacaaataaaatctatatattttacttagtaaaataattgacttttactaaagagatgtattataatgcaaatatcaaaacatacaatttggaggaggtatttttatgaaaaagaaggttttaacagcagcagcacttgtaaccgcaatagcagcttcccttatgggctgcagttcatcggacaagcaaaatacggacggggtaaaaagtatccgttttgcttcctgggataacagcaaggacttagatgaacagcagaagctggtggacaagtttaatgaagctcacaaggatattaaggtgactctggaagcctatggcagtgactttgatacaaagatcgcagcaggcatgggctccaaggatacgccggatgtgatgtacatgtggaattatcctgcttattatgaaggtctggagcctcttgattcctatattgaaaaagaaggacaggcttataaggataatttctatgaaaccctgtggagctataatgagatgggagataccgtttatggaattcccgtaggctttaccacccatgttttatactacaacaaggatatttttgatgcggcaggagtggattatcctacggaatcctggacctttaaagatctagaagatgcagcaggaaagcttactgatccagaaaaaaatatcacaggctttggctttaagcgggttcccgatccctatgattttgaaatgtttctctggagtaacggcacagcgctttccgatgaccaaggcaatttaaaagattatgtaaacagtgatccatctgttcaggtattcagcaccttccagaacatggagaaggaaggcgttgccgtggcaacagataaggacggcacggatgaaatgatggcaggcaagatcgcaatgtacattaacggctcctggcctatttcttcctttaacgatgcaggcttgaattacggcgttgtggaaatccccatgtttaaagaaggaagcccttccgtcagcatcttaagctcttccgggcttgccatggcaaaggattccaagaacaaggaagctgcatgggaattcatcaaatactggaccagcgaggacttgaacagggcacgtattcagtacgaactgccggttttaaaatccgtagtacagtcagaaagtcttgaaaatgacgttgtaaagggtgttttctactccatgttacagcaaagcgaaggatacacgcctacctcttttaagactaagaactggagtgagatatcggattccttgagcacggcatttgagaacatcttcaattctaccgtatacggtgaccccaaaacagtgctggatgaggtggcgggacagtaaggacaagggcccgttgaatggaaaaggtggagaacacatgaaaagtaaaggaagattacgaaaagctactccctatttatttatatcgccctggatggtgggatttctggttttcacactgggacctcttgtattgtcattaatcatgagcttttttaactggtcaatcgtttctacacccagctttacaggctttggaaattacattgaaatgtttacaaaggaccctcagttttataaatccctggcaatcacactgaaatttgcggcgatctttgtacctttaaatctcataactgccctggttcttgccatgcttattacccagccggtcaaaggagttacggttttccgcaccatttattacattccggctgtggtatcaggagtcgctatctccattatctggggctggatattaaacggagattacggtattttaaactactttttgtccctcataggaatcaaaggaccgaagtggcttgtagacccggcatgggcgctttttgcaatcgttatggcaagtgcctggggcgttggtaccatgatgctgatattttatacggacattaagaacatatccatggatttatatgaggcggcttccttagacggagccagccatgtggcccagttctttcagatcaccatacccatcataacgcccaccatattatttaatgtgataacctctttaatatccgcgttgcagcagctgaccctggtgctgctgctcacaggggaggacctttaaagtccacctacttctatggcatgtttgtatacaacaacgcttttaagcatcataagctggggtatgccagcgccaatgcgtgggtcatgtttattgtaatattgattttaacatcaattgtttttaaatcctcttccgcatgggtgttctatgaaacggaagtaaaggaggggaagaagaaatgaagacctcaaaaaaattcaaagtgatcatgtatatcattttaggccttgttgccctgtacttcttgttccctcttttatggatgatcttaactgcctttaagacggaagcagaggcccaggcctatcctcccaaattcctgccggatcattggcttataggaaattttgtcacagcatggaagtcccaggaatttacccgctatttatttaattccctggtggtgaccgttatgacgaccgtggggcagatcatttcctgctctttggtggcctatggctttgccaggtatgatttccgctttaaaaatctgctgtttatgatccttctggcaaccatgatgatcccctgggatgtgaccatgatccccatgtatatggagtttaaggtctttggatggattaattccttaaaaaccctgatcgtcccttccttttttgggtcagcctactatatttttttattaaggcagtttttaatgggaataccaaaggattttgaggaggcggccagaatcgacggcgccaatgcctttgaaatttattccagaattttcatcccaatgatgaaaccccagctgatcttaatcgggatcttaaatatcctgacggtttggaacgactaccttggcccgctgattttcttacaggacaggagcaaatacaccctggcattgggactggcatcttttaaaggggtgcatgaaacgcagatcatacctttgatgtgcattacgattattatgatcattccacccgtcttagtatttatagccgctcagaaatacattgtggaaggtaagagcggagcgatcaaatgacaggagaaactactatggagcgacagaaaaaacggtgggaagaccataccgttacacatattaacaagcttccgggacatgctgcctttgacaggtatctatcccgtgaggctgctttaaaaaaggacaaagcaaagcggaacaacgtaagcttaaacggcagctgggacttcttatacttggaagctccggaatattccccggaggatttttacatgccaaaggctgatacaagggaatgggggctataacggtcccctcctgctggcagatgcagggatacgggcagatgcattataccgatgttttgtatttatttcccatcaaccctccttacgtgccgtccaagaatcccacaggaatttacagaagaaattttacattgaaaaaggaatggctttctaaccgcaccattattaaattccatggcgttgacagcgcctatgacctgtgggtaaacggacggtatgtgggttacggtaaggccagcagaatgtcagcggagtttgatttgacggatgtgattgtggaaggcgaaaaccagatcaccgtaagagtgtaccaatggagcgacggcacctatttagaagaccaggatatgtggtggttaagcggtatttacagggatgtggaactgatcaatgtggaccatacctgtatatgggactgccatatccatacagacttgaatgaaacatatgaggatggtattcttaaagccaaggtttttatggaaaagcctgcaagggatacttcccttcgatgggcattgcttgacgaggaagaaaagatgatttcggaaggttccctgtcctctgtgggggaaacagaagatatccatataccggtggaaagggtcagactatggaacgcagaaaagccctgtggatatacctttctcctcatgagatatgagagagaagaattaaaggaggccatacctttttacgttggcttccgtaagatcgaaatcaaaggaaatacctttaccgtaaatgggaagcctgtgctgctgaacggcgtaaacaggcatgattatgatccgaaaaacggcaggacggtcacagaggaaaatatgctctctgatgtgttgttgatgaaacagcacaatatcaacgggatccgctgttcccattatcctgccaatgagtatctttatgagctttgcgatcaatacggactttatgtaatagatgaggcggatttagaatgccatggctttgaactctcaggggaatacaaccgcatcagcaatgacccttcctgggaaatggcttatgtggaccgtgtggtgcggatgatcgaaagagaccgcaaccacccctgcatcatcatgtggtcccttggaaatgaatccagctttggctgtaattttgagaaaatggcatctgttgcaaaggaaatggacccttcaaggctgatccattatgaggggattcagaagcaaaggtgacggatgtgtattccactatgtacacaaggcttagtaagctgattgaaataggtgaaggaaattttgggggaaataagccccacgtcatgtgcgagtacggccattccatgggaaatgggccgggaggactttggagtaccaggaagcataccggaaatatgaaaggcttcagggaggctttatctgggaatggtttgaccatggcattgagaccagaagaggtaacggggaaatttattataagtacggcggagattatggagatacgccgactaacggaaatttctgcattgacggccttttattccctgaccgtaccccaagccctgcattaaaggaatacaagcaggtgatcgccccggtaaaggcagtgctcataagctgggaagaacagctgatcgaggtggagaactgttatgatttccttagccttgatcatctggaactgcagtggaatataagctatgatgacaaagtcctttttcagggagagattggggctttgaatgttttgccgggaacaaagaaggaaataaagctttcctgcggcaaagtggaagctttgccaaatacggattactacttaaatcttttctttgtactaaaagaggaggctccctacgcaaaagccggtcatttggtggcaagggaacagtttcagctgccggttttcgcggcggaaagcaggaagcatccggagaaaggcagccttaacgtagttttaagcaaaacagagattgtgattcagaatgataatgtgcaggttgtgtttaacaaggtgtacggaaatctggtttcctacaaggcacatggcaggaaactgatgaatcatggaccggaactgactgttgacagggctgtaattgataatgatatgtacaaaaaagaggactggagaaataaatattttcttcacttatccagtgagcagctggaatctgtccaggtagaagaaaaagaagaatatgtttcagtgaccttttataaatatttttcctgtttaaaccagtcctggggatacggtttaatataccgttactgcctccacagtgacggagcattggagcttgaactgacgggaaaggtgagaaaggaaggggaaatattccctgccatgcttcccagaatcgggatacttttccatacgccgaagcttacggaagttgtctggtatggcagaggatatggagaaaattactgcgacagcataaaagcggcctttatgggcgtttacaggggaactgtggacagttttcacacggattacgtttatccccaggaaaatgggcacagggaacaggtgaagtggttcagcctgacagacggcagggaaggcctgttaataaaatcagctcttcctgtgggaattaacgtccatgactacacgaaggaagccttggaaaaagcggcacatacgggctgcattgaaaagtgcggggatctggttgtaaatgtggattacaggcaatcaggacttggcagcaacagctgcggggaagagcagctggagccttacagggtaagcctggaggactttaaaatctctctggaattttcgccggtaaaggcgtttggcgagatcgaagggagtaagaatgtctatttttaacgggatattcttctggcacatcagacctgcctcatgggggcgactggataagcatgcatatccgcttgattcattaggagataaattatgagatttgatatcagcaaaattcctttcagccgctttggttcctactttgttatttcagaagaagaaagcagcggccggtggtatctaagggatcttcacgggggagatgaagccgtatccaatatttatgaaatttcatttccgggtacggaaagctcttccatagaggtggaagccacagaaaccctgcttgtattcaggcagaaggaagaggaaaataaaagggttgacctggtatttggagaagaaaatacggtgcacatggagtttacgggcatgcccgtttatttaaaagccctgggaggaaaatacgacagcctggttccttacggcacaaaccagtgggaacataccttatattccaaggaaagaaggattctctttactgtggtaaagggaaagggagaaagccggggaacctggaaaatgacaggtacagaaggggccggtatgctgtttacaccagaagaggagggcggatatgctgtccttgaaaattaccgtacggtctggaagaaaaaggagtatccatcctttgataaggtatggaagggtctgaaggaagagtacggaaggtggaaaacatccatgccccatattccgggagtatatgaggaagaaacggctcttgcctcttatctttcctgggctaactttattggcatggaaggcgttttaaaagagccctccatgtacagttccaagaactggatgttcaatatctggagctgggacaattgcttttccgccctgccattaagtgataaacagccggaactggcttacagtcagttaaaagtattctatgggatacaggatgcaagcggctgctatcccgactatgtcaatgataagttctattcttacagctgctgtaaaccgccaatccacgcatggacctttcagaaaatgcgaaggaataacccttactttgaagaaaagggcaggcttgcagaatcctatgaaagctttaaacgggtagctgagtactgggtgaactggcgcatcaagcgggtaggcgcccttccggaatacaatcacggcaatgattccggctgggataatgcctcggtttttcatcagggagtgccggtagaatccccggaccttacggcctatttgatccgccagctggacattttaagcggtatggcagaagagcttggcaaagaggaagatcagaaatatttaaaagaaactgcggacagtctctttgacactttgatgaagagactatataatggaagaaagttcattgcacggctggttgttaatggacagccggttacacagggggacagccttctgttatatttgcctgtggttatcggataccgtcttccaaaagaaatacttgaccggatggtcctggatttggaggaacggtttgaggctgcttatggattgtgtacggaaagcctgacaagcccctgttataaggaagggggatactggctcggacctgtgtgggcgccggtcacgtatatcatgctggatgctttgcgggaaaatggctatgaaggttttgcaaggcggcttgctgaaaaattcgtaaggcttgcccccattggactgatggcggaaaattatgatccggtaagcggaaaaggttatgatgaccctgccttttcctggacttcctgtgtttttctgcagttattaaaagaatatccggatatggaggaaaaggaatgaaaaagcaccttggcagcctggggctgctgctcacggcaattatctggggcagcggcttcgtagccaataacatagcacttgagaccatgacacctatgcagattttgtgcctccgtttttttattggcgctgtcttaatgggagggattgcctgtaaaagatttaaaaatgttggaaaacaggaaatcattgcagggacaattcttggtgtgatattatttgcggcctttacggcccagacctttgggctaaaatataccaccccatccaagaatgcctttttaacggcaaccaatgtggtgatcgtaccgtttatagccctcctgctcaataaaaaaagggtggatggctacagctgcgctggtgctgtcatggcgattacgggaattggcatcctttctttaagagggaatttaagcctttcctttggggatgccctgactctaatttgcgccttttgctttgcctttcatatattttataccggggaatttgcccagaaatatgatgtactcatactgactgccatacaaatgctggttgcatttttactttcttttcttgtaatgctgcctgcagaggggataaacctttctgtaagcggcaacgggcttgtcagcgttatctacctgggcgttttttcaaccacaatagctttttttctccagacagtggcacaaaaatatactactgaaacaaaagcagccgttattctgtccatggaatccgtatttggaacgctgttctccattttgatcgtacaggaagagataacggcaagaatggtcgctggctgcattttaatattggcggcggttatcattgcggaaacaaagccgaagttaataatgaaaagatatattgaagaaataaaggaattgtaaaaaaagcagtcaggggtgatatcaatggcaacgattaaggacattgcagaaaaagcgggagtatccatttcaacggtttcacgggtattaaattatgatgaaacattaaatgttcctgatgaaacaaagcagaaagtttttgaagcggcagaagagctggattatatcgtaaaggaaaagaaaaaacgtaagaaaaagctgaatattggcgtatactacagctattccatcgaagaggagctggtggacacctactatctgtatgtccgggtggctattgagaaaaaaatcgctcttgagaaccagaagcgccggatcgtgacggcagaggatacggaggaaagcttaaagaatgtggatggcatcatttgtctaggtacctttaacaggcagatgctgaaaaaaattgaaggctttcacaagcctgtagtatttgtggacagctctcccgacgaatccaagttcgattccgttgtcataaattttgagcgggcaacgaaaaaagttttggattatttaagcggtatggagcataaaaaaattgcttttatcggaggctttgagaccgatgctttaggaaatgccattgatgacatgagaaaaagagtctatgagcgctatatgaaggagttggggcttttccgggaagaatacattaaaatcggagagtataacccgaaatacggatatgttttgctgaaagagcttttatctcttcaagagcccccaacggctgtctttgttgcaaatgattcccttgctgtgggctgctataaggcagccaatgaactggggttaaagatcccggaggacatcagcatcgtaggatttaatgatctggccacaacaaaatatatggttccgcctcttacgacagtgcgcttatacatggaattcatgggagagaccgcggtttccctgatgatggagagaattgaaacggaacgggaaatctgcaagatggttactatacccacgaaattgatagaaagagaaagctgtaaaccgcctaagggagtacaatatcatagaatcactgaaaatgtaagtttgattggtgaaaatgaagatgaagataaaagttttattggataataatacgtatatcgatcaatattactatggtgaacctgccgtcagttattatattgaagtcgatgacagaaagatattatttgacaccgggtattctgatgttctgattaaaaatgcgaaggccatgggaatagacttaaattctgtcacaaacattgttttatcccatggccataatgaccatagcaatggcctgatgtatttaaaagaagaaatcgatttgttaaaagtctccttaactgcacacccgctatgctttcagccgaaatcagaaggagcagaacatatcggttccccttattcggaagaggaaatatcagcgatgtgccggtatgttccggcaaccgggccatacagaatatcggatcactgcttattcttaggtgaaattccggcttttaatagctttgaaaaacgtcataaaataggaaaaactgttatagacggcaaggtggcggatgattatgttattgatgattccgccctggtatgtgatacaaaagaggggatttttattattaccggctgttcgcacagtgggatctgcaatatagtggaatattcaaaacaactatgtaaatgcaataaggttgcaggtgtgttaggcggtttccatttatttgacaacgatcgccgtttaagcaatacggtccaatatttaaaacatacaatagcaggaaccttatatccctgccattgcgtatcgctccaggcaaaagctgaaatgatgaagtatgttgatgtgaaagaagttggtgtgggactgggcattgagctgtaatgatttctaattggctgaatgtacatgatttatcagtgcgcaaggaggaaacggattgaaccggatcgaaggtttgtaattttggatttttctattccctttgcaataagaggtaaataagcctggaaaagttcaaactctatttttcctgttattatttggacgaaaaccttcattgataatctgatgtgaaattataggaggaagcgctttctggaacgcagttctctttctgaatatggggataaacttatcctaagggtggtatgccggtagctgcaatggtgggattggatctccgttttgcaatggatttagatgccaccttccacgcataattgatgcttctcccggtgatgctattactccgaggaaacttaaatatagttttaagctcatgctggaagcctgctgctgtatgagagtgtgggatacgaaagaagtacagaatgcatgaacatggatcaaacttctgcattcggaaaaggagaaaacgatgaacgaacatacacgcttacactgtgaactttttatcgaaaacaaggaacgcatcaaatcagtatttggctgggacggcgggctgatccatctggcctgctccttaatctacactgcaaaggataaaagagctgacgaaagcacgctgcaattctgcaaggaacttctaaagcagaaggttggcgtattttccaactttcgcagcacagcaagatcaccgattgtttcaatgctggctgtcagcggcagcccggagcgcacactggaccagggtctggaggtatatgggttactcaagaaagatttctggggttcggtttatcttcccatggcagcaatgatcattgctcagatggaaaatcaaaatgagtatgagcgcattgctgcccgtaccagaattctttacgaaagaatgaaatccgagcatcctttcctgacatcaggagaagacagtgcgctgtgtgcattgatggcattatcggataaatctgatgataatctgattcatgatgctgaagcctgctatagaatattgaaaccaaatttcttttcaggcaatgcagttcagtccctgagtcatatacttgccctgtgtgatgggcaagctgaggaaaaatgtgaacgaacgattattctttttaataagctgaaagctgcaggtcataaatatggtaccgaatatgaacttcccacgttgggcgttctcgctatgacagatggtgatgccgatgaaattatccgtgaaatgattgagatcgacgcatggctgtctgcccagagtggattcggatttttcagcagcatcagcaaaaaacaacgtttgatgtatgcggggattcttgctcaaaaggactttgcccaaaatggtgccatggagacagcggccatcaacagcacgatatcattgatattggcgcaagaagtcgccatgtgtgcggctgtcgccgcaagcgcgacggcggcaaataatgcggcgaacagctaaaagaaaagactaagaacctgaagatttgtaaatctggatgcttttctattccttatgcaataagaggtaattaaacctggaaaggttcaatcccctgtttttgattatttttaagtgccggtcaatcagatcatcagacgatctgattggccggcacttcttttgcataatgatcccgtgactttcctgttttgtttctcctctgtcagaatttcaataatgatcagcagtataaaaataaaagagattatctcttgacatgttacaaaaaacaaattataatgagtgtatactcattgagttggaggtcattaattgaaatcaaaaagacagctgcaaaaagaaaatacccggaaaaagatcattgaaacggcctgtcaggtttattctgagcaagggttttcagccacaacggctgttattgcaaaggaagcaggtgtgtcccacggcacaatattcgtccattttgcgtcattggatgaattgctgtgctgcctcatacaggatttcggtgatattttgggagcggaaatacaccggttagcagaaacaaaagataatattgaggagctgttaaaagctcatttagatgttttggcccgccacgaaaggttttatacccggcttattgctgaaaggagtttattgcctgaggaggcaagattaacattttcaaatatccagtccatccttgcctaccactttaacaaggtatttgagcgggaaagccatgggataaaagctcttcctgtacacctgctgtttaatacgtggatgggattgattcattattacttgttaaacaaagatttgttttcgccggatacgccgctcttagagcggtatggctcagagcttacggaaacttttttagaactgattaaaaaataaacaggaggaaataagatgaaggtttgtattgcctgcggtatgccaatgaatgaggcttctgaatttgcctgtggtgacactacgaaggattattgtgtgcactgcgcccgccctgacggctccatgcagtcgtttgaagaaaagaaggaaggtaccatcaactttattatcaagacccagggggtagataaaaaggctgcggtccaaatggccgaaagcagtatgaaaaagcttccggcatggaaggaatattttaaccgaatcaagtaagtcagggcctcccccgcactatcggggacgccgtgagcaagtagcgaagcggattgcgaatatccgcttgactggttcatgaggggaggtgatgagatgcaggttagcccatcgtttcaagtctttgcaaaagaggcccctgaggtacaaaaggcatggatggaaatggtacaaaaactggacggcgcaagcgcactggataaaaagacgaaagaacttgcctatcttgcagtgatggctgcagtaggtcttgaaagcggattgccgttccatgttaaaatggcaaaatccaaaggagcaacaagagaagaaattattagcagtatactggtaggattacccgctgtggggaatggaattgttaaatccttgccgatagctctggaggcatttgatgaggaagggtgaaatacggcagaatttgccgtatttcacagagataagttaaaaatagaacgtagcttcactgactgcttcccttagaaaaggatgataatatgaaaaacaatttgacagtaaccagtccggcttttcagaatgaagctgtaataccggttcaatacaccgggcgaggagaagatatttcgccggagctgcatctgtcatccatagatgaaaatgctaagtctctggcggtcataatggatgatatgggacacccgattcctgcttataaccactgggttatatggaatattcccatcatggagataatcccccagaacatcccccacggggcccatattgcagaactgaacggggcaacgcagggacgcggatacggaagaaacaaatatcggggtccgaaaccgcccttcaattggtcccaccgctatcaatttaatgtatatgtgcttgattgcctgttggacctgccagtcaggtccagaaagagggatgtactggcagctatggaagggcatgttttacaggagggctgtttggtgggaagatttcgttaatctgcaataacgtttgcatgtctcatgattttccggataacatttttgtcaggttcgttgaaacttaaaatcattgtcttgacaatatgacgaataaatgttatattgagaacaagttaatagtgagtgttactgattcgatcaggcatcatcaaatacaaatatccgaataatggggatattagtatttggtgattttttttaccgtatttttagtgaatgttacctgaaacggatttgcaggaaaagatttaacgagaagggaggtgttctatgttcgagtttgttaaatcactgaataataacatcgttcttgcttacgacgagaatcataacgaagtagtgctatttggaaccgggatcggattcaaccggaagaaaggggatatggttgaagaatcttccgtcactaagcttttcatcaatgacagcaataaacgtctggcccctatgattcagaacctgtcggaggatattgtatccgccacggaagaaatcgtccaatacggctccagagtattggagaaacaacttcatgcttctattttgattgttctggccgatcatttgtattttgcaatggagcgggcaaagaaaagtcagaatgtggataatcctctgcaatgggaggttccccatttgtatccaaaggaatatgaaatcggagtaaagggggtgaaatccattgaggaacggcttcagataaaattgccgcctcaggaggcatcctttattgcccttcattttgtaaatgcgcaatttgagagccaggatatgagtgacaccctgaaaataacagagataatcagcaggatcctggatattgtcaactatcattttcaactgatattagacgaaaattccttatattactccaggtttatcgtgcatctgcggtactttatcatacggcagaaaactcatatgaaggataccattggattaaacgacgaagatttattggaaacggtaaagacgcgctataaaaaaagctatcaatgcgccgtaaagattgcaaaatatctgcacgatgcttattcgtgggacgtttccaaggatgaaatcatttatttactgcttcacatcgaaagaatcacaagtgtcacaaagaaataataaaaacaagtggtcaaaacaagagtgttactattcaattaggcattgtctgcgaacaagggtttattttattaaaaaaataaaacgaaaaggagactttgtgtatggaacatttaaaattagctcaggagattatccggtattgcggcggaaaggataatattacccaggcatggaactgcattaccagggtgcgttttcatttaaaaaccagagaaaaggcagatgtaaaggctatacaggccttagacggagttttgggagcccagtttcagggggatcagttccaggtgatcattggaaacgaggtattaaaggtatttgaaggggtaaaggaagagctgggtgaccttgtggcttatacggaagaagaaaagcagaaggataaaaaaagggagaatccggttaatgtggtcttcggcgtgatatcggggattttcaatcccattttgccggccattacaggttccggtattataaaagggattctggcgcttctggtttttcttaaaatgctgaatccggagtcaagcaattattttgttttagatatgatttccaatgcaacctattatttcctgccgtttctcgtagctttttcagcagggaagaaattcggggtaaatgaacatttgtctgctacccttgcagggatcatcatgtatcctgcatttgtgaatttaagcggccaggggatcagtacggtgaagtttctgtttctgaatattcctgtaatggattacaactccacggtgatccctattattttgggtgtgctgctgctgagcattgtatacaaatttatagaccgttttgtgccgggctttttaaaactgatcgtgacgcccgtggcttctcttctgatcacagcccctgtggttcttgttttcatcgcccctttgggaagttatgtgggaaaatatgtggcagcctttttcatttccctctttggagtggcaggacctgtggccggtcttctcatgggaggtcttatgtcggtcattgttataaccggcatgcactatgcatttttcccgtctacctttgatggactggggggcgttggctacgacattttactgctgcctatgagcattgtgagcaatattggccagtgcggcgccgtattaggggcggcctttaaaataaaagataagaaaatgaaatccattgcattttccagcgcgctttccgctttgttcggcattacggaacctgccatctacggtgtgaacttaaaatataaaaagcccttttatgccgcattggcaggcggagcagtgggaggagccatttatggtatctttcatgttaaggcttttgctttcagcattcccggaattacagctttgccgacatatttgaaagaaggggaattaaacaactttatctgggcctgtgtgggtgtgtttgcctcattttttacagcctttatcctaaccattgtacttcctctggaagaaaaggaaaagacaaaggaaaaggagaaagagaaagagcctgaagcggtcagccagggtcaggaagggcatatcgtaaaaatacccgttgccgcgccgatgacagggcaagcagtgggacttgcccaggttcctgataagatgtttgcggagggtattcttggaaaaggaattgcgatcatacccgaagaggggacagtgaaagcaccttttcagggacaggttaaaatgattgcacctacaaagcatgccatcggcctgatatccgacaggggaatcaatgtggtgatccatatcgggatcgatacggtgaatctccagggaaaaggctttgaaatcctggtaaaagaagaccagtgggtggagcagggagaacctttgatgaaggtggatttggatgttattaaggagaaccatttaaatcccatcactccgatcattgtgacaaactctgatgaatatgtgaatgtgatggacttgcccacggacatggcccaggcaggaatcagtgaggttttgatggtattccagtaggattccggtaaatgtaaataatttctatcaataaaaacagtaagaaaaggagaatgatcatgagacaggaagtaagatacggatttccggaagactttttatggggaggggcaactgctgccaaccagatcgagggcgcttatcaggaagacggcaaaggtatgtccacatcagattatgctgcttataaagatccctatgcaacgggagaagtgaataactttacctttaatgtcacctcaaaggaactggaagagtaccgggccaatgagggaaaatataaatttcccaagcgctggggaattgatttctaccaccgttatgcggaggatatcgcgctgttcgcggaaatgggatttaaggtgttccggttctccatttcctgggtgagaattttcccaacagggctggaaacagagccaaatgaagcaggatttgctttttatgataaggtgatcgcggagctgaaaaagtacaacattgagcctctcattacattgtcccattatgaactgcccatcgttttgtcagagaaatataacggctggcagagccgggaactgattgattgttttgtccgttttgcagccgcatgctttaagcgctataaggatgatgtaaaatactggatcaccttcaatgaaatgaatatgaatttaaacagcctgtacaccggggcaggaagctttcctgacaaagtggaccatctggaggaggcagcttaccaggcttctcactatcagtttgtggccagttccctggcagtaaaagtgggaaaagaaatcatgcccaatgcaaaaatcggctgtatgatcaaccggatcgagtcctatgcaaagacctgcaagccggaggaccagttacaggcattaaaagcggatcagatcaacctcttttatccggaggtgcaggcaagaggggaatatccgtcatatatgtgccggtattttaaagaaaagaacatcaacctgaaaacggaaccggaagattttcagatcattaaggattacacggtggatttcatcgcattcagctattacatgacccacgttacggaggacaggccggatgcaaacgagctggccggaaagctggacagccctatcaagaatccttatttaaaattaacggagtggggctggcccattgatcccatcggacttcgaatcaccttaaataaaatgtatgaccgttataaaaagcctcttttcctggtggaaaacggattgggagccagggacaagatggaggcggatggaagcattcatgatgattaccggattgattacattcgtgagcacataaagcagatgaaggaggcagttacagacggcgtagatatcatgggttataccacatggggctgcatcgatttaatcagctgcggtacatcggaaatgacaaaacgatacggtttcatctatgtagatcaggatgatgaaggaaaaggaagcttaaaaaggtctaaaaaggattccttctactggtataaaaaagtcattgaaagcaatggggaagagctgtaagattgggaaaaaatcagctgtggcatgaaagaaagtcctgagaagagtatggaataagttttgaaagaatggcgcagcggaaaggctgcgccattttcatagggttgacaagctaaaagatctatattgatgccaaaacagacacaggtgctgatatgcctgcctgcgtctgtaattaggaatggaactataaaattttatcacattggttttaaattcttttctaaacgatccaccatccatgcaaggcgtttgatgcgtccggcatcggttttagcatcaaagtatgctctggcataagtcttctgcacagacggaggcattccctgaaagtttgtataagcctgctcatattctttcagcagaccggctactgattcaatttgttcacttgttacagcagaaggtacggctgaatgatcccattgcccattacttttggcttccttaactttttctctgccaaaatcagtcatcagcccacgtgtttccagactttttattaatgacttattcttttctgaccacttgctgccttttcttcgtgcagaaaaatatttcatataggaatgatcatcaactcgtttcattaatccgtcaatccatccaaagcacagagcttcttccagggcttcccccgctttaagcgtctttaattccttggtctttccgaacagcagccagactccatcacccgacatgcaattatgggttagccaaatccggaactcatctcgtgttttaaaatgcaaaagttcgctcataacacatcctcctgtctgtgtgaaaggtcaagcggatattctcaatgaccaagggtcacggcacaccccgcaccatgaggtggaccctccgcttcgctgcttgtcaggaggaacttctacgcaacctgactgggaattatttgattcagttaaattttattttatcaaattatatcatggatgcatggaaaagaacagagttgaatattaatatgcatattttcgactctgttctttaaattctgcttatctgtgccatactttcgtttaatggtgcgtttcgttccggcaggctgtccggtaagtgatgattgatgtgagtattctgcctgtaaaatctgtttgtgctggccggcggtttactcacattaccgatctgctgttgaaatagtgtttagcctgttgcttctatatttatagtcatggtcactcagttaacatgtatgtttctgtgttttcaaaatctaaggtgataacagctgaatcaaaggcaatttcaaagaggactaagaaatcaccggcctgttctatagtatctttgtagcctgggattttcttgatgaaatgttctgctgcatcaaacaccgtgcggctgcttttttttaccgtgcctttcgccctgatatgctcattgccctcgtgaggaatggttgtaaatgataccttgttgctgctttcaaactccctgaccttctcattatccctaaaagaggaaaagcatatcactttggccgtttcgtcaaagtagaaatttacaatcctcacatttggctggccgtcaacacaagtggccaatgcaatttcagtttgtgtgttcatcaatcgggtgaattcttgttttgtattcatgattaaaactctccttgtattatatagtcatagcttttctttaccttttcttaggtatgagctatgctgttttagatactgtggattagttcatttctcctaccacttgatggtttagtaaaggctctaaccacagtctctttgttcacttgttaatcagttagataccgcatgacggtttatttagaacaaggttacaatcgcagagagccaccgtggtctaaaacagtatcaaattcatttaataggagtttcgctatgatatacgcagggattgatgtttccaaggataagcatgattgttttatcatcaactcagatgggaagattctctttaaatcctttaccattcccaacaaccgggaaggttttgaggtcctctatcagaagatcacttccactacagatgatttaaccaatgtaaaagtaggccttgaagccactggacactacagttataacatcttgggctttcttcttgataaaggtctgaccacctttgttatcaatccgttacataccagtcttttcagaaaaagtctaagccttagaaagacgaaaacggataaagttgattcccatacgattgctacaatgcttatgtctgatgtgaacttaaagtcctactcagacatatcttaccacaacgaggaattaaagtcactaacccgttaccgttttgataaagtcagggagcgcgccaagcttaaaacttctgtttcccgtctggttacgattctttttcctgaactggaaaagctggttcccactcttcatatgccttccatttccgctttactaagcgaattccccggtgcttttcagattgcttctgctcatcttaccagactgaccaatctgctttacgaaacctctaagggtcgttacggcagagacaacgccatcctgttcagggaaacagccagagcctctatcggttcgaatatgcctgtaaaatctctggaactgaaacacaccctaaagctgataggtgaattagatgccgaaattgatgaaatcgaacaggaaataaaacgtatcatggatgaactccattcccctattcttacgattcctggaatcagttaccggatgggcgccatgattctagctgaaatcggtgatttttcccgttttgactctcctgataagattcttgcctatgctggattatctccctctacctaccaatccggacagttggaatcttctcattcacatatggaaaagcgtggttccaggtatctgcgctacgcactttttaatgctgctaaatttgtctgtaagtgggatccggtatttgccgcctatcttgcaaaaaagagggcggagggtaagcattataacgttgctgtttctcatgctgcgaagaagctggtcagagtcatttatcggttagaaaaatcgggacaggcatacaacaaagtctcttaacttttctgtttaataattttctttttgagcacctgtaaagatgctctgtttgtcatgcggttttcaaggtactgatttacttgaaatgcatttctgcaattcattcataaactttcttttttagacttgacttttaatagttagtctttactttatttgttgttatgattggagtataatgtataatggtgtcaattagtgaaaccatttaactgaattaagtaaatcccccacttcaaatgcaaaaagcattaagtggtgggtgggggcgctgtgactcttggtcattggatgcatccgcctgactcagaaagaggaaaaattcatgaaaaaatcagaacggttaaatgatatgatgatatatttaaatgataaaaaatcttttaatcttaaaagcatcatggacagatattccatttccaaaagtacggcacttcgggatatacagtccttggaagaaatcggcatgcccatttactccaagtccgggcgaaacggatattatgggattcttcccaatcgtttattatcccccattgtctttacaattgatgaagttcacgcattgtatttttctatggaaacgcttaatgcctaccaatccacaccgtttcatttgaatgtaaaaaaacttaagcaaaaattcgaagggtgcatatcagaggagcggataaaaaagctgcggaaaatggaattgatttttagcttgggaagttaccagaacaggaatgaatgtaactgcctgaaagatattctgcaaatggcagttaatgaaagtgtgtgtgaagtcctctatacaaagggagaggttgaaaagcagtatgatgtccaattctttgatattacctcagcctacgggcagtggtatgcaacggcgttcaatttccagacggaaaagcctcaagtgtttcgctgtgataaaattcattttgtgaaaccctgcgataaatatatggcaaagcctctttctgaatttctaatttcatctaaaaaaatgtttcgggataaagaggcaaccgactttgaggtcggtgtttctgataaaggagtggatctattttataaagagcattatccgtcaatggagctgcatcatgaaaatgggaaatattatataagaggattttataacaaaggggaagaagcgtttattgcggattatttcactatctatggtgaaagagttttttctattagaccggccggcttgaaaaacttaattcttgagcggttatatacgataaaaaatcattttatttcaatatgatggttaacaaagtaaaataagggatcagtcggtcaggctgatcttttgtttttttagacatcttatcaggccgacccataaacagtttattttattcgccttatatggggtgactgaataagccttttattttctcatgcagcataatactttatgaaataatgtaatataattacatttataacttattattttaatatattgtaaaaatgttacatgcatgctataataacaaacataagcgcttatatcataaaaaaccatacatattgcctatgaagtgaaaaggcatgaggcaggaaaaggaggtaaaccatgcagggagtttctatgctggtcgtcattggattgattctgtatacggtgattgctgtagtggatcagatttccattcaatgcggattgtataccccgttgttcgcggcagtgattaccgggggattattgggagatttacagacaggtctggtggttggtgcgactttgcagctgatgacattgggagttgctacttatgggggtgccacggttccggactatttatcaggagcgatcatggggaccgcttatgcaattatttcgggacagggagctgaatatggcatcggtcttgcgattcccatcggactattgctgacccagatggatattttgggaaggatgacaaactctttctttcagcattacgcagaccgctgtgcggaaaagggggattacaaaggagtggaacgggcaaatctcctgggactgcttccctgggtcctgtcaagggtaatacccgttgcgttggggctgtgctttggcgaggctgtggttaatggagtaaacgctgtaattccggcctggttcatgactggccttaaaaccgcaggcgccattcttcctgcaatgggtatggctatcctgatgcgctatcttcctattaaaaaatattatccctattttattttcggctttgtgctgattgcctttggaggcggtacctttaccgttatggcggccgcattggtcggcctggctttggcagcacttcatcttacaggagcaagggaccgggcggcagtgcagacattggatgatgaggaggtagaaatcgatggctgataaaaaccagacaggaaacgggaagttggaaaaaggcgatatcagaaaagtatatctgcgcaatctgttcactttacaatttggctggaattatgaaaaaatgcagggccttggctatgcctatgtcatcatgccggttttaaaacggctgtactccggggagccggagaagatgaaacgggcattaaagatgcacctgggttactttaacacaacaccggcaatgtctcatctgatcatcggtgcggatatggctttggaggaagaactgggaattgaggcggaagaggctattaccggtttaaaaaccggacttatgggcccgtttgcgggagttggcgatactctgtttattgccatctaccgggccatcgtgttctccattgcatcttatattgccatgcaggggaatcccgttggacttattatccctctcattgcctgcgggggaattttatggatacggtatcaattcaccagcattggctatcagtccgggcgaaagcttgcgaccggatttgcggataagatttctcctgtaacagaggctgccagcatcctgggcttgaccgtggtaggggcgctgatcccttccgtaatcaaatacaatacggatctacagtttaccatgggagaagtgacctttgccttacaggatatgctggataaaatcatgccctccctgcttcctttaggaatcgttgcattttcatactggcttctgggaaagaagaaggtggattccacaaaattgattttcattctgattgttttaggcatgttacttggcaacctgcagtccatgctgacctttgcagccggtttgttttagaaaaatggaagttgaaacaggaaaggaaatagtggtatgattggaatcatagtaaccggtcatggagaatatgcctccggtttgaccagcggtttaaaactgctggctggagagacagaatattatgaagcagttgattttaagccagaggattccatggaagttctggcagaaaagctgaggtcagcgatcaggcggctgaaggactgtgaatcaatggcagtgcttgcggatctgacgggaggctccccctttaatgtggcctccagactgaaaatgtccggtgtccatgaaaatatggaggtggtgggaggtatcagccttcctatggtactccatgcctatatgtccagagcaatgatttcagatatcaaagagcttctggatgcctcccttgagatgggaaaacagcatatgatgtattttcaaccatcagatgaagcatgtgaactggaagaatagggacaagaaaaggaggaaaatccatggcaatagtgcatgcaagagtagatgaaaggctgatccatggtcaggtggctatggtttggaccaataccgtaggagccagccggatcatagtggtcaacgatgaggcggttaaggatgagatgatcattgcaggccttaagatggcaaaaccggcaggcgtaaagctctccatcctgtctttaaaacgggcggctgaaaaatttgcggaaaaggcttatgaaggggagagggtatttctgatcaccaaaaacgtgacggatatggcggaactgatccgctttgaagttcccatcaaggcctttaacgtgggaaatgtggcaaaaagagaaggaagcagacccattaaaaagtcagtgaatctgacggaagaagatgaaaaggatatccgggaaatgataggtttgggagtgagcgtgacggctcagatgctgcccaatgagtcggaccagtccattttaaatatgctgtaatataagcggatacagaaggaggcggaatggaatcagtcaggttaaaaataagagaacaatacaatgaaatgagcaaagcagagaagaagatctcggattttgtattgtcagataccaaaaactgccttggaatgacggcagtggatattgcaggaaaaagcggggtatcctccgcctctgtgatccgttatgttcagaagcttggctttgacgggctggaaggctttaagctggcacttgctgcgaccgatgcccaaaatgataaggaagatatggtggatcccattatctccagagaagatgatttagataccctgtgccgaaaaatggatgccctggtggatgcggcatttcaggattttttctatcagctggataaagatgcattaaaaaaagcaatcagcaaagtaaagaaagcccggcgaatttatttggttggaatcggaagttcttcgctgccggcttatgatctgttccataaactgaaacgggctgacatcaatgcgaatttttaccaggatatcaatatgatggtggagttttttaattacattgacaaacgggatgtggtgatcgcattttcctacagcggacagtcccaggaagttctgtatgcctgcagggcagcaggaaaacagggggcatcggtcatagcgatcacccgcaggggagattctccccttcaggaaattgcagatatatgcctccatgtgccggacaatgaaaaagtcatgcggatcggtgcgtttacctctcttcatacctccatcatgatggcggatcttttgtacatgggagtgatccaggagaatttagagcattatgaggtggagctgatcaaaaccagaaaaatggtagaggggctgaaaataaaaaaatagaggagttttatgtgcaatatagaaaagcttacaacggaatccaccaatgaatccacccggaacattgacaggctggaatcattggaaatcgttacattaataaataatgaagacaaaaaagtggcggaagccatagaaaaggtgcttccccagatcgcagaagcagtggaggcaattgtggatcgttttaaaaaaggcgggcggatcatttactgcggtgcaggatcatccggtcggatgggcacactggatgcggtggaactgactcctacttacagtgtaccgccgacccgggcctttggtcttcttgcaggcggagatgaagccatgtatacagcggtggagggcgcagaagattcagaagaactggcattggaggatttaaaacgggtaaaacttacctccgatgattgtgtgatcggcattgctgccagcggaagaactccctatacaatggctgctttggaattcggcaaacaaacaggtgcctttaccatttccgtcacctgcaatcaggccagcgccatggcaaagatcgcggatatatccattgccccggtagtgggaccggaggtgatcaacggatccaccagaatgaaggcagggactgcccagaaaatggtggtcaatatgctatccaccgcagccatggtaaggcttgggaaagtatatcggaactacatggtccatgtgcagcccaccaatgaaaaacttgtgaaacgggctgttaagatgatcggggaaataacaggtgctgaagaggagctggctctcaaggtgctatatgaggcagacaaggaggtggccgctgccattgtgatgatcgaatgcggctgccaaaaagaccaggctcagaaggctctttcagagtccggcggtcaggtgaggaaggccattggggctgtgaaaaacggagtttatacagatggaaagagcctggaatgatgagaatgaaaaaatattgaaagaaatggcggaacagctggttggagaacaggtgatacggggagccagcctgggctttgtcagtgaccggggaaaccgcctgatgtacatcggaaatcagggggcattggcgccctattgtgaccggaatgtggaagcaggaatgtattacgatctcgcttcgctgacaaaggtcattgggactgccacccggattctccagctggcggaaaacggagccataagtctttctgctcctgtgaaagagatcctggaccggttttcctatggggatataacggtggagcacttgctgcttcatacaagcgggcttcctgcggagatacggaacaaggaaagctggagccgggaaaatctactggaatacctctacacaacgcccagggaaagggtagcgggagaagggttcctgtattcagatgtggggtatatcctgttaggaaagatcattgagcgtgtggatcatacaacccttgaggagacctttcaggagcatatcttccgtcctctttgtatgacggatacctcttatttcgttcatggcggcagggatcgctgcattccaacggaatgtacagagcaaagaggctgcatctgcggggaggtccacgataccaaggcttacttgctgggacaatgcggcagcgccggtttgttctccacattggaggatgcggcgaagtttgttaaggcgtatctggaacattcccagctattgtttggagaggagatgtttgaaaaactttgcagcatgataaagtttgaacgcactctgggctggagcaaggagtatggaagggataccctttatcataccggatttacgggaacttctgtattgatggatttgaggagcagaaaagggttcattctgctgacaaacaggattcatcccagcaggaataatgaggagttcttaagggtgagaaagaagatgaatgaaatttatcttaatatggctgtaaggaacctttaaaaataaggggcggctcttttgcatagagctgcctcttatttttaaatgggaaatcataagcaatcagagaataccataatcgaaatcctgattgttaaaaatttatagtaaatatgaaaatagtttagttgagagcgaattttctccctgttataatgaagcaagtaaaagaagttaataaaaattggaggtatttattatgaaaaagagatggttggcactaggagggctgctccttatgctgtcactgacggcctgcggcaaagcggaaacaaagacagagacaaatgaagaaaccaaagcggagacttcccaggggcagacaggggcagcggctgcagagggtgagaaacagaaggtggtattctggtcctggcagccgacggataagcagattgcagagctggaaccggcgtttgaagccgcttatcctaatattgatctggagtattggagaggagagctgcccgattatcagaaaaagctgcaggtggccattgcatcaggagaaggtcctgacctgatggggatgcagacaggtgcgatgctgaatcaatattcaaagtttttagaacccctgggaccgattgcggaaaacagcttcggggccggctgggaatcaaaatttttaactgatgctatcaatgaatgtaaagatgtaaacggaaattacgtggcacttcccgtcaacgtaagcgggcagcagtttgtgatgtataataaaactcttcttgatgaagccggaattacaaaaactccggccacctatgaagagtggaaggaaattgttgaaaccttaagggaaaagtacccggatatcgttccggtggtgtacggtgcaaaagaggctgataaatgtgtggatatgttcaatgccttaagccagcagttcggaccgggaaaattctatgaggcggaagagggaaaaattccatggaccgatcaggtatttgtggataccatgacggcatggaaacagatgtttgaagataaaatgttccaggatggtgccattggtcttcagatgtatcctgatgcatctattaaatatttttttgacagaaaagctgtgatgtttatgaccgggtcctggcagccgggagcacttcagcagggcggaccaaaatataacggtgccaccaatgatgatgaattcggaatgtttattcttccccagatcggaccttacgagtcaaaagcagtagttagcaccgatattgcggttgctgtcaataaagatgcaaaaaacaaggaagcggccattcttttgatggaatttatgacacagggagagggcagccagatcatggccaaccagttaaatggtaccccggctaatgtcaacgttactcctgaaaacattgattcactggcagcagaatcagagcgtgaaatcattccttatactacggaactgataaaaaacagtgcagggaagcgattccttaatgataaggagctggtatcggcactgggtgtggcaatgcaggatgttgtaacaggaaaagatattgaaaaagcgctgcaggaagtgcagagtgcttatgagaaactcaaataaatgaatggcagcaggggatgaagaaattgaaattcggaaaaaaagcaacaccatacttgctattaatacccatatttttaatcagcggagtattgctctattattgtatcggctacaccttttttaccagtttccacgagtgggatggcatcagtaaagacatgacgttcatcggactggaaaattacatcaataccctgaccaatcccactttttttatcgccctgaaaaataatctgatcttttttgcggccacggtatttgtacaggcagttatcgggttgctgctggcagttgtgctgaaagaaagatttcgcggaaacacagcttttaaggggttgttttttctgccggttattatggctccagtggtactggctaccattttcaggatgatactggacacaaacattggagccttgaacattatgctgacaaatatcggccttaagtccctggccgtatcctggctgggagatccgaaatatgctctgttttccatcatctgtgtaaatatctttaactggatgggattcagcatgatgacctattatgcagggcttatggccattgatgaacagatttatgaatcagcgaagctggatggggccggatttttcagaaccttgttttccattacccttccaatgctgaaagggacaacggccagtctgatcatgcttggcattgtaggatcgctgaaaacctttgatattgtctttttgatgaccggcggaggtccgggaaggtcgacggagtttttaactacgtttctatttcggaaatccctggatgaatacaacggaggccaggcatcagccataggaatcatcattctggtcattgcccttaccatggcgatggtccagaacagaggctatgaaaaatcagaagaagaataggaggataccgtgaaaagaaaatatctatggaaatggctgattttactgcctatggccgcgatctggtgttatcctctgttcgtagcctttaaagagtccctggcaattaacggcttgggaaattatgaagcggtgctcaaccatcccagaatcagttaccccagagtgctgtttaacagtgtattcatatcaattgtatcaactgcaatcgtggtagtgatttcttcgctggcggcctatgggttttcgaagtttcagtttaaagggaaaaagctgctttattatctgctggtggcttgtcttaccctgccgccggcagccatcatggtacctcttgtatttttcggcaaaacctttaagctgaataatacctatacttccatgatccttatcatggcatcctttcatgctccttatatgatggttacaatgagaaattacttttctaccattccggatgcattgctggaagcggctgtcattgacggcgcttcgccaatgcagatttacaggagggtgatgcttccattggggcttcctgccattttaaatgtatgtctgttaagctttatctactgctggaataactatttgattccgcttatttttgtaacaaaagaacccatgtataccatcaccctggcaactacctacctgacagattccgggaacatgaccatggagatgcaggctcagctctatgcatatctgattctggcgattcttccgtcggtactgttatacatgttcttaaaccggtatttccgttccgatatgacatctggtgcggtgaaataagaaaattagggatttgctgacaggcaaggagacgagggatatccgcttgattcattaggagacaaaatatgaaaaaaccaaacattttattcctggtgggggaccatcaggcttactacggacatgaacagtattattccatcaggcgtccggcatatcaaagattggttgcaaaaggggtggactttaagcgggcgtattgttctacgcccctttgctgtccatccaggcggacgatggcaaccgggctttacgccttccatcacggccagatcaataatcaggcatctgcggattacagttatgaaacctatatggactgtctgaaaaaagaagggtaccagctttattattatggaaagtggcacgccggaaagggaacccccggtgactttggtgcggaaggagtattctgtgaggattatggaaatccctacctgcttccaacctaccaaaaatatctggaggagtttaatcttccgttcccggtggcatatatagaacaaaactggtgcactcccggctggattgatgatataatggagggcagcgaataccggcttgacagaaagactatgaatgaatgtatctcaggcattctaaagactccgaaagaaactcatgaggctttttatctggcttatgaagcctgcaaaaaactggaagagctaaaggataacagtcagccgttctgcctgcgtgttgatttctgggggcctcaccagccctacttgcccacaagggagtattcggatctttatgatcctgcatccataccggtttatcccagctttgaggatgatttaagtacaaaaccggatgtctatcattttgaaggaggaaagggaatcagtgaaggttaccggattcttcagccaaaccctgttccctgggaccaatgggcgaaaacgttatcacggtgctacgggcagataacattaacggatgaagccggcggtctgattcttgataagctggaggagctggggctggcagaaaatacattgattatctggactgcggaccatggagacggcctggcctgtcatggcggtcattttgacaaggatgcttatcttgccgaagaagtcatgcgtatcccggcaggagtccggtttgacggtcagcttcctgccggtgtgatcagccatgcgctggtgagcaatgtggattttgctcccaccattctggatgcggcaggaaccaggtttggcgggcaggtggacggcaggagcctcctgtccatcttcagaacaggagagaggccctggagagaggtgttgtatggggagacctttgggcatcattttaagcacagaggacagatgatggtggatagaaggcataaatatgtgaaaaataaagagcagatggaagagctttatgatctttatcaggatccttatgaaatggataatctggcgctgaagccggaccggcagcagcttctttccgacatgagggaaaggctggagtcctggatcagagaggaaggaatagatgaagcctaatatattgtggatttgcaccgatcagcagaggtttgacagcctgggctgttacggaaatcaaaagattgatactcccaacattgaccggctggcagaagaaggggtgctgtttcagaatgtttactgccagagtccggtctgctcaccctccagggcttcttttctgacaggtcgttatcctcgaacctgcagggtccggcagaatggacagaaaataccggaaaccgaacggctggtcagcaaattgttcgctgacagcggttatacctgcggtttgtccggaaagcttcatattgctccctgccaccccagcgtcagtccgtcctctgaaccaagaattgatgacggataccatgtttttcactggtcccatcatcctgatttttacggaaaaaaagaaagcaactggccgctgaatgaatataatatctggctttcggaacaaggggaggcttataagaggattccatatgagaactcaaagtatgtatttgtgggtatggaccggcacttaagccagagcagatggtgtgcccataacgccatcagctttataaatgctcacagtgcgtatgctcgtccatggtttttctctttgaatttttatgaccctcaccatgattttgacccgcccagggacttgcttgaaaaatatttacaacgggtggacgaatcagatctgcctgattatgaggcagaagaatggaggcaaaagccctatgttcagcaaagagaccataaaggggcttacgatactccgggatttttcgactttgatcagatgactgatcaggatcatctgcaggtcaaagcggcttattatgccatggtagaattaatagaccaggaagtggggcgtgtaatccatgcgctccgtgcaagcggtcagtatgaaaataccattgtaatctttacctctgatcatggtgaaatgctgggagatcatgggatctatttaaagggaccttatttttatgatccccttgtaaaggttcccctgatcattacctggccgggaaggatcttggagggaaaagagagagaagccctgactgagcttttagacctggcccctacgcttttagacttggcaaatcttgacccgtatccgggaatgcaggggaaaagcttaaagaaactgctcacggaaaaagatgcgccggatcatcatcgggatgcggtctactcagaatattataattccatgggaaatcaccaggatttaaaagcatacctgactatggttgcagaccgtcgctataaaatggtgtactgtcacagcagcagccagggagaactgtatgacagggaaactgatccgggagaacacaccaatctttattaccgctcggaaatgacaaaggtccggctttccatgctggaaacaatgacaaacaaaatggcttttaccattgacccgcttccggacagagaggcgatttattagatccagggagtaacgaatgagacgtagtattaaaagaaaattgcagttaagcttcacagggatttttcttgtattaacagtgttggtttgtctggcatggtacaagatgatgggagatatggcaaaggaccaggcggttcggtattttaacaggacagtggattctctcaatgaggaatttgacagtctgatgaaggatgcgaactatatctccctgatcctatcttttaatgctgccgatcaaagtcagattttaacgggaaggaatgccattgaaacctatcgggagctggaaagcgaccggattctgacacgcagtgtcaacgatttttactcctacagaagctacatctcaagtattatgctttgtggcgtcaatggcagggtgttttcaaacggcgtggttttatcgccgggagaaatttccggaatgccgtggtttactgatctggagcagtctggtcagaatggaatatttattaaaacccactccaacgacaccacggaaaaccgccagaaaagttatgtcatttcggcgggccggaaattgttaaacggtgataaacatatcggttatcttctggtggatatttcctatgaatatatcaataaccggttcagcaaatcagtcatggatggcagcacgctcctgatcatagatgatcagggcggggtgatttatgacagcaattcccctaaagtgcccgtggatactatttatgataccagattcaaagacatcataggaaatttaaacggtcagcaggaccagatcagtattaaaatcggctcaaaagagtaccttgccatctataagcggtcagattttactaattggactaccatatcattgatgccgacagaaattattttaagggatgtcaacaaaaccttaaatatggttgtgctgttaagcattgtctgccttgctgccggaatcttgctgatcggtaaattcagcaccctgctgacgagaaatgtgctgaaactaaaagaatatgtagaccatgtggatgccagtaatttaaaggcactgcccagcttaattccggggatgaaattggcgctttgggcacaagttttaatcagatgattgagcgggtgaatcaattgatgagtgatctggaagacagaaaacagcgggagcggcaggccgagtttcaggcgctttacgcacagatttcaccacattttctttccaacacgttaaacaccatcagttggatggcgggccggcagaacgctgccaatatcagtgaaatcaccacctctctgataactcttcttcattacagcatgaaaaataaaaatgaagtagtgactctgaaggaagaattggaatatgtgaaaaattatctgaccatacaggaatatcggtattatgggctgttcgatgtaaagtattcactggataaggagacagggggctgccggattttaaaatttatcatacagccgctggtagaaaattcaattatgcatggtattgccaaattgcagaaacagggtaaaattttaatcatggcaaagcggagagaagaccggcttgttatagttgtagcggacaacggtgtgggtttttctgaagagacttttaaacagcataagacacatcatatcggacttgataatgtgagggaaagaatcagcctgttttacggagacgaatattttcttcagattgagagcagagaaaactattataccaaggtgaccatggaactgccttatatcagagaagaatcgtaaaggcgggaaggtgtttttgatgggggaataactggatgctgcatttgatgattgtggatgatgacgcgctgatgggaaatcaactggcagcaatgctggactggaaagaattcggcgtggaaatagtttattttgcttccgatggccaggaggctattgatgccctgaaaagccatggagttgattttgtcatgacggatatggagatgcctggggttgatggggttgcgctgatcgaatatatcagcgttcattatccggaaatttatgtggtggcattaagtgcttatgatgattttcactatgtcagaggaagcatgaaatatggagctcatgattatctgctgaaaaacaagctgtcaaaggaggttcttattgggatgctcacggagctaaaggataaggagcagatcgcagatgagctgaaagcacatcaggaactgactaaagaacagcttcaggactcttttttccggagagtgctgtttcgcagtgactatgataaagtacagatcggacatatcataaagaatcttaacattccttttaataaagactgtctgtcagtattgcttgtggatggtgatttttttaatgatcaggtattaagccggtccgtatttcatatgtgtcaacagattttaaaagatgcagattttgtgaaattgctggaactggatcagggcagcttttgttttatcatttcttttaggaccgaagtcagccaggcggcggttttaaagaaactggagcagtggggcaatacgattattagtaatggaaggaagttttttaatgtttctgtcaatataagcatttcggaggtttgcagcgatatttcaaagctgaatcagttttatcgtcaggcggtgaaaaacggagagtattttttctacgatgacagcctgtcgatgatctgtagctgggcatttactaataaagctagggaaaaaagtcagaaactccagtttccggatatcagggaattgaaaaaatggattatggatggtaagcaaaaagaaatgacagatcattgggaacaattttttgaacatgccagacagatgagactgccggcaggagaattttcctcagaggctgcacttcagctcaatcagattttactttttggtgaagaactgggggcaagcaggtattatctgttaggtgaaaaagaatattccttcaatgatttgaaaaatatccgcactttaagccgctttaaagaattgtatatgtctgtgattaaacggctctgtgaagcggtaacgccggaatacgaaaataatttttatcataaatatacgaaatatgctttaaaaaaggttcataccagttactcacagccgctgaccttaaacgatattgcatcagagctttcagttactcctgcctatatcagcagcgtgtttaagcaggatatagggatcggattcaatgaatacttaaataagcttcgaattgaaagggtgatcgaacatatcagaaaaggtgacggaaaattaaaagacattgttaacagtgtgggctttcagaattacaattacttttttaaagtgtttaaggaacatacgggattgacgcctgcgcagtatttcaggtgatcatttaggaggacatcaggaaatgaaaataaaaaatccggtaccgatcagcaatatcggcgatccatatattctcaaagtgaaagatatctattatttatatgccaccagccattttaacggattttactgctggaaatcagccgatctgtcaacttggggcgagccggtgatctgttatgaggcaacagataaaagctttgggaacagctgtttctgggctccggaagtgtatgaatttaacggacggttttatatctattacacggcacagtggaagatttttaaagaagaaagcttaaggatcggagttgctgtttcagatcatcccgaaggcccgtttatggacgttcatgaggaagctcccatgtttgattttggctacggggtgctggatgctcatattttaaaagatggagaaaaaaactatctttattattccagggccggagaggggcacatggttgacggagccaaagaatccgacctctatgtggcggagctggctcatgatcttatttctgtgaaaggtgaaggagtgctgattgccagaccggaacaggaatgggagaggaaagaacgagaagtgccccagtactggaatgaaggggcgtttgttattaagcatcagggtagatatcatatgatgtattctgcaaatttttatgcatcggcagattatgggattggcggagcggttgcagatcatcctatgggtccgtttgtgaagtatgaagataatccaattctttccaccagcagcaccatttccggaccggggcacaacagtgtagttaaggtttctgatggaacatatttttgtgtctaccatgctcataccgactatcagaacccaagtggagacagacaggtgtatatagcgcccatgtggtttgagaatggaaaaatcaaggtggagtctccgttaatcgagaaataatgtgacatctgtacatgtgtgtgatcactctatgtatggtagttattaacaagaacgttttgttccaaaccgatatcagacaaaagtttcaagtatacatcaatcttgccatgctcgtccaccacgattttgtcaatgacacgtttgagctgggcattggtcatgtgctccatagaaagaatactttctaagtccttaaatgtgttatgaagcacctgctccggctgattgcccttgcttagattgtatttaaccagttttaattcattctcgcacttctcaatctctatattaagagatgatacctttcctcttaattcttctctggttatcagctcgttttgccctcttgcttttagtgggcaattctgagtaccagcagttccctaccttctgcgactgaacacccagctcctttttggtggttttcaaggtgcgctcggaaatattctgcttccgggtctcctccaatagtaccgaactttcctgcctgccctggctcagcatcatgagtaaaagtacctttgcctccttcaacacattccgcttgatttccgtaaagcccaggagcgcgtccacggtgatgcagctcgtccctaaaaagcggaagatgtcccccaactcaaaggcaatggagtcaccagtgggagcaaggttgcttttactgtgcgccataatgcggatttgcgggtctttcggggatctttcaaccaccagcacactgcgagcggcagcggtgatgtcgatggagcccagtccacggtatccactttttgctccacacttgttcatatggccgatgatgaccacggcacacccggtttcctccgcaatctgccccagcttgtggaaaacagggcgaatctcattggtacgatgcataccacgtttgccccaaggtaagcctgtaaggggtcaaggatcagcagctttgcgcctgtctgccggatcgcctcactgagagaaagcatggtcttgctctcgtcaatcacagaaacccggtcacagtcagcggctatcgccagcagtcgaggtttgatggtatcggacagaccgtcctctgcagtttggtaaataacgttcataggcggctgtggctggcattccggcaatggctctcccttggtgagcagtgctgtaatagcgagaattaggtgtgtctttccctcgccgggatcgccctgcaatatggtgattttcccaagggggatatagggataccacagccatgcaaccggtgttacatctagtgcataaaacccgccatttcaccgagtattgtgaccgaaaaatagaaaacggccgcacctgcaagcaagttggaccgaaagcggtattaaatgcacagttggaaaaacaggagaatgcagcactcaaggagtatgaccgcgttcgcaaggcgaagcagcagaaacgggagcgggacaggaataaggaaacagcggagaatgccgggaaagcacaggcggcgtatgatctgtggtcggagcctgcgatagcggcgagggagaggtttgttgctggggagatgtcggagggggagtttttgagggaaattaaaaagagtcaggttgatgctgatattgatgaggtgaaatgatgatatttgtgacaagtgatacccacggagagtacactcgcttcaagacggtgctgcgtaaaaatacagttgggaatcttgcacttacatgccaaaccgtcacccgggcgggatgcctttttcactgccctcaagaaatcgagacaataaccgcatattcacctattcatattttcttaacttaatgtattatcgtctgaactgttacccttggtaatgaaataaaaatacagaataaaatatttatattgtaatttaattacgcatggtgtataatactattaaagatacatagctataagaagtgagggatacactatggattttccaaatacaggttatcagttacgggtacaatcaatactggctgaaattacgaagaatgaaaagaaaatttatgaatttattgaaaacaaccggagagacataattcatatgtctgttgcagatgcagcggaagcttgtgaggtcagcgagccgacaatcgtaagatatgctcaaaaacttggttataaaggatatcaggcgatgaaaatcagtattgcgcaggagagcattgaaccggaacaacaaatctatggtcatcttgcaaaggatgatacgatttcgacaattgtcaataagattattgactccaatatccagtcactaaaagacaccagcgatgtacttaaccgggaaagtatcgatgatgcagttaatctgatcctgggatgccggcggcttttattctttggtgttggcggctctggctgcatagcactggatggacaacataaatttataaaaatcggctatttggcaatggctttttctgacagtaatctgcaggcaatggcagcgtcagtcttaactcctaaggacgttgtggtggccatctctcattcaggggcgtcaaaggatattttgatggcattggaaatcgccaggaactcaggggcgagaactattgcaattaccaactatggtcggtcgccgattgtcgacagtgctgaagttgtactttttacgtcttcgaatgaaactgcatttaacagtgatgcactatcttcaagaattgcggaactgtctattatcgatatgttgtatattggtgtttcttacaaacgatatgatgaatcctatgctgagatattaaaaacaaggaaggctttggatgctacgaaaatttaagggggtgataaaggcaggagatgagggattactttagaggaggtgatggaagccggtcaacatttatggaaatcaggaaaggaggggaaaacatgttttgtggtattgatttgggtacttccggagtaaaggcagcagtttttgacacccatggaaaacagctggcatttgccagaagggaggtggatttagtccatccccggaccggatggtctgaactggaaccggaaaattatctgaataaggtttatgaggttatacaagaggtatcagaacaatgcagcggtgcaataaggtcagtcgcagtatcctctcaggctcaggcggttgttccgatcgataaggatggaaaagcattatataacatcattgtcaccatggacaacaggactttgaggcaatatcagttctggcaggaaaattatgatgaatgggaactgtatcagcgcactggcaatagttttgcttcaatttacacagtaaataagattatgtggcacaaggaatatatgccagaggtctatgaaaatacctggaagttctgctgcgtacaggactatgtggtttttatgctgacaggaaggggaccatttattgattattccatggctggacgtacgatgatgctgtctttagaaaaacctgagtgggatgaacggatattaaaaatcgccgaaataccaaacgaaaagctgtctcaaccagtcagagcgtcaacgattgtgggaactgtaaaacaaaatatcagagctttgacaggactaagaaatgattgtcaggtggttctgggaggtcatgatcaggcttgcggagcaattggcagcggtgtgctcagacaaggccagttgatggatgcctgcgggactgtagatgctatggtttctgtactgccgggtgtgaccattgatcaggcgatgcttaagaataaactgccatgttacagacatgtggatggcagcagttatattacaatggcaattaatacaaatggtggtttgtttttgaaatggtataaaaataccttcttcaatgaggaatcacagttgtgcagcaaacagaactgtgatatttatacacatatgattgaggggtgcgcgaacactcctgctgatatctatgtattacctcatctggaaggtgtaggtacaccagtaaatgacccgctatctcttggagccataattggcttaagagtcagtcataccaaaaaagacattacccgtgctgtacttgattcgctggggtatgagatgaaactgaatctcattgcaatcgaacagagcacaggtcagaaaatcgaagaaatccgcatgataggcggtggcgtcaaaactcccaaatggttacagataaaagccgatatatttaacaggaccattactacattgcagacacaggaagcggcagcactgggagcagctatcatcggagctgttggaaccggatattttagagggtttgagcacgcagtcagtgacatggttcaaaccgcaggaacatatattccggatccgaacatggcccaaaaatatgaagtcagattttccgagtataaaacaatctatccggaattgacgaatatcaatcatgccatttccgatcgtacatctttattataattctattttaaatgtttgtcaaataattattggtatcccagtgatacttttattaaagtatgctaaaaatggaggatttcgaatgagtgggtttacattatcaatcaatttagcaatctcgattgcaattatattattattagttctcaaattaaaaatcaacccgattatttctatggttctggccagtttatatatgggttatcatgtaaactgggaattattgatacgattacaacaattaacagcggctttggtaccttaatgacaggaattggttttcctattggttttggaattatgatgggtcagattctggaggattctggtgcggcggaatcattggcaaaatctatcttaaaggcatttcccggtaaaaaagcaccctgggctttgggtctgactgctttcttattatcaattccagttttctttgacgttacttttgtgattctgattccgttgggaattgcggttgccaaagagacaaaaagacctctggcatattttgcaggagcaattgcaattggtggtgtcagttcacagacatttgtaccacccacacctaatccgctggcagcagccacaattctgaactttgatttgtcctatatcattgttgccggaactgtcatcggtctggctgcggcagtattttccatgtttgtctggtttcggatgctggaccgtccgggcttctggaacccagaaaaggatgaaaccggtatgctggatatggatgcggaagtggtcataagaaaggatctgccatcgccgatagcagcagttatcccgatctgcctgccagtactggcaatcttaattggttccttctggccggttgtgaccggaaatgaagctcctgtgatcattcagtttctttcacagaaaaccattgcgattttattgggattgctggcggcttatgtcatacttttaaagcggatgagctggtcagggatcagtgcctccgccagtaaatctttgcagcaggcaggagtggtattgttgattactggtgcaggcggtgcatttggtgcagtcatccaggcgacaaatattggtcaggttctggttgcaggcttgtctgaagggcagtcctccacagtgctgattctgacacttacatttggcatcggtgtactgttccgtgtcgctcagggttcaggaactgtagcttctatcacagcgatgaccattatggcctcagtggctccatcagcgggctgtcacccggtctatatcgctttggcagctctggcaggcggtaattttatcggtcatgtcaatgactcggggttctgggtggtgacaaatctttccggagccagtgttaccggcggtttaaaaacatatacctggaataccataaccctggcaggtatggcatttatcctgtcattagttggtgccatggtgatgccaatggtataaactttaataaaacaatgaaaaataaggagtatgaataatggcaatgttaggaaaagaagtaagaatgagccgactggtgaatccggagagtaataaaatgatggcaatcacagtggatcatgcaatttcaaggggaattgctctgctaaaaggacttcatcagattcaggaaactgtggataaggttgtgaaggggcgtcctgatgcaatcaccgtgacaaaaggaattgctgagcattgtatgtggccttatgccggtaaggttgcgatgctgatgaagatatcaaattattcgccggcagaaccgacgaaagacacgattttcggatcggtggatgaggccgttcggatgggtgctgacgctgtttctatgggagcgatgacatttggtaactttcagagtgagcagtttgagtctattggcaggatttctgaggagtgtatggcaaagggaatgccgctgatcggtcatgtttaccccaagggcgagatggttcctgcagatcagcagactgcatgggagaatattgcctattgtgtacgaagcgcctgtgaattgggcatggacattgtaaaaactacatataccggcgacccagattccatggctaaagtagttgcctgtgtaccatccacatttcggattgtgattcagggcggtgacaagtgcaagacattggaagattatctggtgatgaccagagaggcaatggattgcggtgttggcggtgttacaatgggccgttttgtatgggagtatcaggatgttacagcattgataatcacattgcgatatatgattcataaagggtataccgtaaaagaagcgaaagagcttctggcccagctggagcatgaccggaactatgacagtttttaaccgatgaggagattgattatgaagattgtagttttagatggttataccgaaaatccgggagatttgagctggggagcgttggaagctctgggtgaattaaccgtgtatgaccggacacctgcggataaagttgtggagcgaattggcgatgcggaggtggtgtatacaaataagacacctttaaatgcccatattatcaaaaactgtccgactataaaatttattggtgtattggcaaccggttataatattattgatatggctgctaccaaagctgccgggatcgtggtttccaatattccttcctatggcacagatgcagtggctcaatatgccatcgctttgctattggagctttgtcatcatgtgggagcacattctgacagtgttttggcaggggaatgggcaaagcatgaagactggtgctactggaaatatccgctggtggaactggcagggaagacattcggtgttattggctttggcaggatcggcagaagaacagcacagattgcatcggcttttggaatggaagtgctggcatatgacgagtattccgatcagatggagaagacagatttttgccggtatgtatcgatgaatgaacttttaggacaggcggatgttatcagtcttcattgtcccctgacaccgtctacagaaaaattggtcaatcaaagtacgatttccaaaatgaaggctggagtgaagattattaatacttccagaggtgcattgattgatgaacaggatttatgtaatgcattggatagcggcaagataagtggtgcagcggtggatgtgatatccgaggaaccaatccgggcagataatccgctgttgcatacaaaaaatataattattaccccacatattgcctgggcgccgaaggaatcacggcagaggctgatgggtattgcagttgacaatttaaaggcatttgtcgatgagaaaccgattaatgttgtaaaccaataatactgggcaggcaggacggcttgatagccgagttcgatgagcggctctggcacaccctcgtggaattcgccacggtctacagcgaaaacaatgtgcggttcacattcaaggacgggacggagataaaggcgtaagcgccactggaacaacaaacggatgctgtaaattgcgggtatccgtttgttggtatttgtgaaaaatctttctcattgattatgctaaagtcaaacgaattaggatttaataatacttaagctcactttcattaacaacgccgctataaatgactgtataaaacgtattgccgtcgtattcatatgctgtgtaaggcaccattctattgtttctttcagtaaatttttctacgggtacaaattgagcaatcgcatcttctttactgtaagaactcacaggaaagtaaaaatcctcgccctcgtttgcccaaccttgatactttgcacttattacatgatacctctcctcaccggccataattcatccctacacataaatgtaatttgttttcacaactattgataaacatattcatgcagcctgaacaccaaattcttgttcttaatcgctattgagttttaggctggacacatacgattcaaaggagttcacatctgattccaaagaactgaccctatcctctaaatcatcttggcttgcctcaataatagtcaaccgcgtgttatagccccgcagagtcataatcacttcaaccattaactccttttcactcaaagccataagagcatctttttcagcctgaattctctcggactcaattcgggcttcttcttcagcccgctctctggcgatgcgctcacgctcttcccatttgagccgactctctcctcacaaattgaaggcacacaggccacccttgatgatatcttagacccacatattgaacagaatactaatcataatgtttctgaggtcattaactacattaaagcaacagactttgcaaccgagcgcctgaaaacgctgcccctgtgctgccgtctcctgctggaaacccatgaggtgctgctaagtgatgtgcgtgacagtgaaaggaaccccggtgagtttcgccgcagtcaaaattggattggagttcaaggaagtacgctgaagacggcaaggtatataccaccatctccggatgatatgcaaaacgcaatgtctgatttagagaagtacatgaacgaaacagaccaaaccgacccactgattaaaattgcgttgattcactatcaatttgaaaccatccatccgtttttagatggcaacggacgtattggacggctgatggttaacctgtttctcaaagaaaacagactgcttacttacccgacactttatatttcttatttcttaaaacggaaccgtattaaatattacgatcggctgaccgaggtgcgggaaaaagggacctttgaacaatgggtcaagttttttcttcaaggtatttatgagtctgccgaggattccatcgaaaccatagatgcattggctgcactccacgacaaaaatatttctattgtaacggctacggatacccggacaggtattctgaaaaagctgtttgcccacttagagcaaacgccgattatcgacattaagaaaactgccgctgcgctggggaattcttataataccacctccaccgctgtaaaaaagctcatgaaacttggcgtccttgttcaggtagataatagcaagcgcgaacgcagtttctcctatgaggaatacctggcgatacttcgtaaagatacgtaaccacaaacagatatgcgttctgccgattcaaatcccctgcaaatcgccgccagcactgtgttttcgcaaagctgacggcgattgttattttactattttacttctatccataaccattctatattgttacttctgcatgtacagatgttttttaataataatattatctgcgggtattgaaaataagaattttgtttatttcaataaatatttgaaataatagatattggtgtgaattggacaatacattgataattattaaacagaaaggaagctgttatggcagataaaaataatatggaagagctgttccggcaaatagaccatcacttgcttcatgacgaacgtccatcggaatatctggaagaaatcagcagggaaccgtggtttttggattacccgttttccatgcttttaaagatgaaggaaactcctcagtcaaagcggtaccatccggaaggaagtgtatggaaccataccatgatggtagtggatgaggcagcaaaacggaaaatggagagtaaggatgccaaaactctgatgtgggctgctttgcttcatgatatcggcaagccgggcgtgacgaaaaaccggaaaggaaagataacctcatatgatcatgattcggagggagagcagctggcagttgattttttatcctgtttttccggtgatgaatcatggatcagagcggttgcaaaactggtccggtatcatatgcacatcctgtatgtgacaggaggacttccttttggcgatattgccggtatgaaacgggaaacagatatcagtgaagttgcacttttgggactttgcgaccggatcggaaggggcggaagcattctggaagatgaaacaaaggcggtcagggaatttcagaagaaaatgcggaatatgtagattaaattacctccattgagtctcctatgataaaatgaatcatttatttcggctaaaaagaaacatagccggttgaattgttatgccgctgtagttaaatatcttcttagcatataacattgggaaatagccaaacggtcattgttgtattataataaaaggaaagctgcaaaaatcaataaaattacagaggtttacaatgaaaataaattatggaattatatcaacagctgccatcggaaaacgctttatcggtgcggtgagggccaacggagggtcggtgaccgcagctgcgtcaagatcactggatactgcaagggcattctgcgaggaaaacaatattgaaaaggcctatggctcttatgaggaactttatcaggacccgcagatcacagctgtgtatattgccaccataaaccgggagcattttcatgagatgaagcaggctttgaatcatggcaagcacgtgctctgcgagaaaccgtttacgctgtcaaagcatcagtcggaagaaatctttcagctggcaaagaaaaaggggctgtttgttatggaaatgcagaagagcctttttcttccggtcaccggtctgattaaatcatatattgattcaggtttgctgggaaaactccatcaggtggatatgagtgcatcctttcaaagccctaaggctacatggatgcatgaaaaggatcagggggagttgtttacggaagcgcttcctatacctttgaatatctggattttttactggagcctgccgatgtaatcgtgcaggccctgggaaccagaggtaaaaccggagtacaggattctgtcagtcttaatataaaaatggatgatgtgctgatcagcagccgcatttccatgcgtggatcagcggaaagctttgcagtattttattttgaaaaagggtttataaaaaccaatgaatactggaaggcagaccgctgtgaaatacataccggccaggggattgagcagattgaaaaaccggtggattttgagatgatatatgaggttgcacatggggatgagtgcatcagacaggggctgacggagagcccggttatgactggtgaaagaactctgcgctgctgtgagattgtggatcaggtggcagcagccttagaacggcagcaggggagaggagaatggtgaaagtgggataatggggaacgaatgaggaccggaatttattgtagctgattccataagtaaagtatgcaaactttcctgcaaatcattggttgtgttcaaaaattcctgatgcacatcaataaaaaatatgatacaataggaaaaagtaataattggaggcggttatatgtttgcagaagaaaggcagaatcaaattgtagcccttgtcaataaaaatggttctgtgcgtgtaaaagagctcagtgaaaagtaccaggtgacagaggacagtatacggaaagatctgacgtttcttgaaaaaaagggacttttgaaaaagacatatggcggagccatgaaaaaaagggtgaatgttcatgacttgaatgtatcccagagaaaggacaagaatattgagattaagcaaaagattgcctcaaaagccatagaactgatcaaggacggggatatggtatttctggatatttccactgcgaatctggaactggcaaagctcattataaaatcccctttaaatatcaccgttgtcacgaatatggtggatattatgctggagtttatggttcccaccacagccaggctgatttttattggagggtcgttcagcagtggaaaggatgggtttgtgggaagcttcaccaatgaacagatttcagatttccggtttgacattgctttcatgggagcggttggagtcgatgtgtttgaaaataacgtttcgacctatatggtggaagatgggcttacaaaaagtgcggtgctggaagtgagtaaaagcgcctttataatgctggagaccaggaagtttaataccgacggcacctataaatatgcaagaattgatagttttaccggtgcggtaatggaaaatatgccaccgtccgaaatagaagaaaaattgaaggaatttaatattgagtgtttataaatatgaaagttcaggtcaaaaacatgcttttccgttccggcgggggaagagcatgttttttttatccagagccagcaggactctctcattatatttcataaggactaaaatactgctcaggggtaaatatcttttataaataaaaagtaataaataacaataataactacgttgacaaaaataaaaagaaagaatatactgaaattagaaaaaataataaataggaggaaaaaatatggagaatctgataatgacagaccgcatcaccatcctgaagaaaaagatgctgtcagagccgagatatgcttctattgaacaggcaaaaatcatcacgaatacctacaggatgaatgaagagaaaccaagaataatccagcgggcattgtctttaaaggcggcattaaaacagatggaaatccacgctgaaccggaagaactgattgtaggcaaccggacagccggggtacggtatggagttgtctttccggaaagcggaagtacctgggtagaccgggagtttgaaacacttcctacaaggtcacaggatcaatttgaggtcagacaggaagatattacatatttccgcgaggtgatcaagccctactggaagggaaaatctctggaggatgtgctgcgggaacgctacgggaaagaaatcgaccacattgcaaaggtggtgaaaatcaaccagaaagaccatgcccagggacatatatgcccaaactgcagggaatggcttcacaaaggtccggcaggaattaagagggaggcagatgaccgcttaaggatcgcaggcgggcggcagagagaattttttgaaagtgtgtccattgtgatgggcggagccctccatttcatggagcgctatcataagcttctgctggatatggcacagcaggaagaggaggcagacaggcgcagtaatatggaggaagttgcccgcatctgcaaaaagctgtctgaacagccggcggaaaccttccatgaggcggtacagtctttgtggttcctttttgtgattctccacatggaatccaatgcttcctctttttcgccgggaaggatggatgaattcctttgggaatattttgaccgggacagaaaggaagggcgcttaaatgagcagaaagcattggagattattgagtgcctgtggctgaaattcaatgagatcgtatatatgcgcaacgccaatagtgccaagttcttcgcaggctttcccattggatttaatattgccataggaggacaggacgcagaaggaaatgattttgtcaatgatctctcatttcttctgttaaaagcccaggagcacttggggcttcctcaacccaatctatccgtaaggcttcatgagcatacgggggatgaccttttaaagcaggcagtgaaggtggtttccatgggaagcggtatgcctcagtttttcaatgataaggcggtgattccctctctggaagatctgggagtcgataaaaaggatgccagggattatgccatcgtaggctgtgtggaacttaccactcagggaaacagcttaggctggagcgatgccgccatgtttaacttaaataaggtcctggagctgacgatgacaggaggaaaatgccttttaacaggggaacagctggcgcccgactacggagacttaaccacctatggaacctttgaagagctggaagctgtatttcaaagatacttggatgaatacatggatttgatggtaaaggcctgtgaggaggtggaaaaagctcacatagacttacttccctccccatttttgtcctccgttattgatgaatgcatgaaaaagggaatggatgtgaccgcaggaggagcccgctataatttttccgggattcagatgatccaggtggctaatttagcagatagtctggcagctctaaaactccttttatttgataaacataaggtggaggccggtgaacttctggaagctcttaaaaatgattttaaaggaaaagaagtgctgcgcaccatgcttttaaacaaggttcccaagtatggcaatgatgtggactgggtagaccggctgggggtcaaatgggcggaatatttcaaaaagcgtttatctgggtataccaattacagaggcggtaagtatcacaccggcatgtatacagtctctgcccatgtccctatgggagagaatgtaggggcttccctgatggaaggcatgcagggcagcctctggcagacggtggaatgtcccctgtatatggacgtgatattgcagggcctacggcagttttgaaatccgtatcaaagctggataaaaacttgactacaaacggtggtttgcttaacatgaagtttttgccggaatttttccgcacacagaaagggatcgataagtttaccttgtttttgaggacctttgtggatctggagattccccacattcagttcaatgtggtcaggaaggaagagttgattgcagccaaggaaaaaccggaacaatatcgcagccttacggtccgggtagccggctataccgcttattttacagagcttgccgatgaactccagaatgagatcattgcaagaaccacctatggggatatctgatgggaaatacaaaaaatatggaggcaatcaatatggaagagagggcggtaaaaggtactgtttttgatatccgccgcttctccacccatgacggtggtggaatcaggacgaccgtgttcttaaaaggctgtcccttatcctgcgtatggtgtcataatcccgaggggatcagcaccagggtaagacccctgcatttccccaataaatgcattggctgccggatctgctgcagcctttcggaaaatggcggtgttgtgatgacagaaaagggaatcaggctggatatatcaaaacaggagaactgggatcagattattgaggaatgcccctccggagcgatcttgtgggacagcaaacgcatgaccgttgatgaagtggcggaagaggtgcttaaggatgcttctttttataaatacggcggcggcgttaccctttcaggaggtgaacctctgcttcagccggaatttgttctctcttttttaaaagcgatgaagaaaaggaacatccatacggcggtggagacggctctccatgtgccagaggaaactctggaatctgtacttccctggctggatttgatttatggggattttaagatttttgctccggaagtgcataaaaaatatatcggccaagggaatgcacggattaaaaagcacataggccttttgctggattcggagaaaagggatcaggtcataatccgtactcccatgattccaggtgtaaccacaggggaagacaatattgcagaaatcagccggtttatttccgaggcttacagtgaggtatcttatgaaatattaaattataatcctctggcagaagccaagtaccgtcttatagataagacatattgttttaaagagaatccaaagcgttattcccggcaggacatggagcgttttgcagagatcgccagatcaaacggggtaaaaaacataatcatagaatcataagaaggagaggttgcaaaggtatgaaatttattattgacgatgcagatattgagaaaatcagggagttgtacgccacatttgcagtagacggcgttactactaaccctacgatcctggcaaaaagcggaaagcagccatttgaagtcctgaaggagattcgtgatttcatcgggccggaagcagagcttcacgtacaggtggttgcggcagatgcggagggaatgttggaagaggcccacaggatacggaaggaacttggaataaacacttatgtaaaggtccccaccacgaaagaggggctgaaagccatgaaagccttgaaaaaagatgggactaatgtgacggccaccgcgatctatacccagatgcaggcatatttagcaggaaaagcaggagccgactatgcggcaccttatgtaaaccggatcgataacctgggagcaaacggcgttaagactgcaaaggatatccatgatattttcaagaaaaatggattaaaaacagaagtattggcggctagctttaaaaattcccagcaggtgctggaactttgccagtatgggatcggcgcgtccacgatttcccctgatgtcattgagggactgatcaaaaatgattctgtgaccatggcggtaagcgcttttgttaaagattttgaagaactgtgcggcacaggcaggaccatgaaggactgccggtaattaaaaaactcttaaagcacgttttttccggttggaaaggagagggaattcccatgctgactgataaagctctgcggattataaaagtacttgtacttaataaagatactcctataactgtgaagatgctgtccgtaatgctggatatgtctgaacgcacggtgaacacctatttaaaagaggtgggaagcttttgcgaaaatcatgggatcacctatgttggaaagcggggagtaggcgtttatctggagcagagcggtggtttaaaaaatatgaaatcaccctttttagaaaatcccgcacaggagtgaaggctgaaggtacggagatggggtttcgctctgccttggcggcactgtgcagagaacaggagaaagaacttgaggagaatggtccttcctatgattacaggattggaagccataaggcagggcacttaaaccaggtttatgaaaaaagtcttgtgcagggagtttgccaggcactccagctgtttgaaacaaagtcgcatatggtttttgtggatcatagctttatcatgatggcggaatatctttgcgttcagataaaacgcatgggaagcggccatgtgatcagggaggaagaactggcctttctttcccctgagggaaaaggggatgctctctcggaaagcctggcagacaccctggagtttgtctgcagggtacaatatcctgcagaggaacgaaactatgtttatctgctgctttccggagcgtaattccagagtcacagattttggccgttttatcaacacttatatttggtttttagcataaaactgtggttagcccccattatgggaaaactaaccacatagtattacaagttaactaaatgacattggctcctgagcagtaaccttccgctattttccggcaggacagaggcagcattcacttcccaatagaaagtgttcagcggttatagaattcccaggaacgctcccaggaaagctttttgccgggcaaaaggcagatggggtaaaagacttccaccgatattaagtgatccaccgcccagatgtccacctgacaggggcgaaagccttctgtgaccttgataccggcttttgatgaggaatgaatcatttcccaggaaaaggtatcacagggcatgatatcctgttccggtatggagtataaggcggagctgggattatacccggtaaaggtaaatccctgctcctggtatttgagggttccggggaggattccggcttgaggccggattccgggaaggctgatgtgatagccgtcccccagaggcagatgctcgatcgttaaaaagttgtggcaatattcctttgcctggatttcccggcttcctgtgttgcgtaatacggtgcggcagatcagacggtttccttctacggcaatctgccgtttctggaaccagccataccccgggcccatagaagcctccatgctgaatacggcggaattgccggttaaattccaggtcaggggaaagggctgcacctcatacgtctcatagaagcaatagggtgcctggcctttctttttcataaggccgataccgggcttcggaaaaaatgtatcaggagctgcttctgagcacatcagaggcgcaatgaattcactgcacagccccagcccgccggagctgggatgagacaggttctctggttcagaagtgcagaattccagttccccatccagaagtacagaggttatgaagcctgatcggtcaaagcggcaggtggtgttgggaaaggttcccggttctgccagagtgactttcagtctgtcggtggaaagtgtcatatgagccccctttataattccagatagtcaaagccaagtaacccggctgtcatgcccagctccgtcagccagtttccgtcagccagggcgtaatgctgggtgacgccgaattgcagaagcttttgaaacagttcttctgcaggcagtctgggctttagaaggccgtgggagtagccggccaggaagtaatcgcattccactgcatctaaaactgtggcggccattttaaaggaaccgtctttctgggaaatgtggaccatggttttttcgccggggccgatcagatgccaggcaaatggggctccggcgtgtttatagccggattttgcaaagcgggtgtccagggatatcttcgtcctgcctgtgggacaggtatagtcctgtgggcctgcgtgtcctgcggcaaaggtcccgtcctgagaattgatataaaacggttcaataaaatttacatggcagccggacagcttttctaagatgtaacatcctaagccgcctcctaagtccccttccggcacgaccatgagatcgtcggtgccgggacagggagagaagccgggacggaggccgatccgttttaacagcatggtatccacatcatttaaaaccagcaattccacgcctgcgtttctggctaaggattccatggcaagagaggcctccacagaagcgaacatctgatccatctgaagctctccttcatgagggtacgccgccagtatatcattgacggccgcccaggttttttccgggggcgtatttgcaatttcttcttccaggccggaaacggacagaaagcgaagctcaggaccggcattcataaaaaagctgtaagggtcaacgtatgtggaccacatgacctcgttaaaggatggcagcagtccaaaggcagtattctttagttcatttcttaaggctgcacaacgggaaaaggcttccgtttctctcatcacacggtctaaagagcctgtgaccgtatgaaacataggccggtgaaaacgggcaattgagccggaagcctcaaggcttcccacaagaccgcctgcggccaggaaatccacaaaggtatcctctgtaaaagaatcggagaaaccgggccgttcctctgtaattgcagcaaaaaggatggggacaggaggcatgtcacgcagaaaacgaatccaggcgtaatcatcggaccaagacaggaacatggcaaaaatcaggtccggtttttgggaagaaaaggccttcatggcatggtccaaatcgcctctggtatagacgattcccggaaataccgtatcggcaaagataaaatgtgacagcaggctggaggcagcttcttcctttctttcatagaaaaaaccgtgctccgtccctcgcccaggcggtagaacctgggcgttgaaataagcaaaatgccaatgcttggcttctttaatgttttcataaacagtcctttctgtttatatacaccattattcgggattgaattgaatatgcttcttggcggcagcaagccgtgtcttgtccaaggaggcctttacatggttgtattcccggctggcaacggccgtataaaggacgtcaatgaccgtaagctggccgattcgggagcccgtggggccgctgcggatcagtgcttccgccgatgaggaatagagacagatatccgccattttggccagaggattcttggaatacttcgtaaggcttatcaggactgcaccggactgttttacggcctccgcggtctctaaaatgtctttcgtgttgccggaataggaaatcaggacggccacatcggaagggcttaaaagggaggcgtttaagatctgctggtgtgggtcggcggtcgacatggacagcttgttgatccggacgaatttattgcaggcatccatagccacgtaaccggatacagccactccgtaaaaatccactcgctttgcaccggctatggctgcaacggctttttccagttcatctgattttaaaaccgagagggtattctcaatcgccctgatatcatttgcgcagaccgtatttttaattgaatctacagaatcaccgggctgcacatccccataatcatcagaggacagagactgggattgaaccaagtccaccgaaagctcccggcagagcgttttgtagccgtcatatccggcggatttgcataagcggaccacggttgaaatactggttccgcaggactgagccagttcgttgatggacatttgtatgacatcggaaggaaaatcgatgatgaattgtgctaggatctgttcctttgatgtcagggaattcattaattctttcagcttgaaacgacagtctgccatatggctctgcctcctctcccggttcgtattttaggtttattatatcaaataatggtatcaatagtaactagaaaataaatattgtgcggctccccgcagagggacgtaatcagaatcagaatcggaaatggtgcggatttccatgggagcagcaaaaagcccttcttttaaagccggaagaaataaatcggcggactttgatatggcgcctcccagaaacagcagctgaaatccattttccattacgatgggcagcaggatggcggaaagatgggtccccatttccataaacacctgctgtgcttctttttctccgccgcgggcaaggtctgcaatggtctttacttctgtatcctcccgtaagaagggggagagctccctgtagcggcggaggatccctcgctttgaaacgtaatcttcggcagtttttcccagatagggacggccgaaaatactgatgccgggcccgccggagggattttctaaaatatgtccctcaaccatggaggcaaatcccagaccggttccgatgatgacgccgcagagcctctccggaaggggagaaagtccggcgcatgctccaagaaggaacgcagtggaatcatggagaaagcatatggataattctctgccaatgcccttaaacagccagggctttaaagaactgccgaaaactgcttcatatttgtggtgcatgaagaaccgcccgttttcatagtcaaaaggaccgggaatgcagaatgcacatccggatgctttcacctgcagtttttcttccataagccttgcgctgtgccccagctcccaaaaggcttcctgaatttcttcttccgttccgtcggaatggaccggaatggagaaaaaagaatcctttattacattatttttatatacaaaagcggcttttaaggaggttccgcccccatccacggaaagaatgcaggaatcagagctcttcattttcaaatccgtcctttaacagggtcttgtgcatggttacaaccccatcccctctgttgatcacctcatagggaccgaagcctgcaggcacgatgaccatatccagataatcctgaataaagtaacggtccggccttgaaagggaacgtatcatgcattgttctccttccaccagaaccagaacgtggaagcggtctgctgcttcatcttcatacccctttgtaaagcgtacgtttctcaggctgaaataaagaagcggatgttcccctacgatagattctaaaaagtcggtgccttcccgcaggagcctgggcttctgaaccaggttttcttccacccaggaagctttgcgggttctgtctaagaccttttctccgtggaaggtgtggatcgggcggagattgccatccaagtcctgccggaggtaatcgtacatcttataggtataggagccaatggtaaggctgccgatttccaggatgacctggtttcgcccggaagcgtggatggttccggcgggaatcatgaactgcatgcccggctttgacggaagggaatggacgtattcatcgtggtcaaagcctatcttttctctttccgcccgcttcgtcttttcaataaaatcttccacgtccgcctgttcggtaaagccgcagtaggtcttggcctcctgtccggcagtgactatgtaatagctttcatcctggcgtcccagttcgtcattatgctccctgatatagctgctgcccggatggacctggatggacatattgccgctggaatgaaacgtgtcgtcataattaaagcggatggggaaatagccgtgaaatttttcggcggcagcttcccccatgagcttcggtccaataatttgaacgaagcagtaaaaggggaattccatcataagctccttcatgtcggccacaatggaaacctccatggggatcagatcaaagacccaggcacagttcttcatttcctttggcagactgcgtaagtgctggacataatacccgccccatacgccttcaatatagaccggacggcagcgcagcggataggtcgtcatggtggaaaacagggcttttaaatgctccgtggaaatcatctgtataccatccggattgtctcctgccaaataatagctgatgatgccgtcccgtatgacctcctgccggatgggaaagctggcctcaaagtcgatgtaatagctgtgccgtatcatttcattataggttccctgctctttgattcccaggttgccgcatttcccggccctgatgttgagtatggtccgcttctgagtcatatccatataaattttcaaatcatagaaagggcggagggcagggatgagcgctccgtttccatacacgattaagagcccgtctccgtggctcctaaagtcctctgccatttgtatcatatggctgatctgatccggttccatcaggccttccataccgtcctgatacagtcggccgtaaagaagaaccggatccgtttccctgttttccggcagataaggaaggagcttgtcgtgaagcttttggctttctatccacagcatgtccgtggaaagggtggtgacctttatcccttttaaggctgcctgaatggatatctgaccggccagctgttcaaatggggcgctgataaagccgtctattgccaggacgcagaatttctgctcctgaaggaggagctgcgtctcagataccagcttctttgccgtgtcaactgttgtttttgtaatggaagaacaaaattctgctcccatggggatgtgattgaccgctttggggtcatcataggggtggggattaaacataaagctcataatcatacctcttttcctaaaaattacagtactttttgttaacttcattttacatgattattttcataaatgcaatattattttcaaaaataaatactatttatgataaaaatttttataatggcataaaaagaaaaaaatagaaaaaagccttttatatagaaaaaataaataaataaataaaaaaaacagaaatattattggataaaattttaacaataaatagaaaaataaagattacggtgaaaatatatgtcaaaaaatatttcgaaaaatgataaaaactattgacttttaaaaactcagttactataatgagattatcaaaaacgtgagaattttataagaaaaggaagtgggagcatgacatggttaaaaaaggcccggggcggaaaaggattgaggtacttaagacggaactggatgttgtatgcaatgattttgccgggaatcttgtacatcatcatctttaaatattttcccatgtacggaattactattgcgtttaaggattataacggaatttctgatatttccagagccccatgggtgggaatggagaatttcaccaaactgttttccacaagggcctttcagcgggcgctggaaaataatatcgtcatcagccttgccaagctcctgttcggatttccggttccgattatcatggctcttatgatagacagtgtccggaaaagcggaatgaaacggctggtgcagacctctgtcatacttcctaattttatttcctgggtagtggtctacggtctgatgtatgcgattttttctcccagtacaggggcggtgagccagcttcttcaatttctggggtatgacgggaagctgcctgacattctttcctctaaggaaactttccgcagcgtcattgtcggctcccatatctggaaaggtgcaggaatcggcaccattgtctatctggcagccattacgggaattgaccagcagctttatgaggcggcggccattgacggggcgggacgtttccgccagatgtggcacatcacccttacgggaatccgcgccacaatcatcacccttctcatcttccgtgtgggagaggtcatgtacgcaggctttgaccagatttacgccatttccaatgatgccgttatttcggtggcggatataattgatacatatgtgttccggatcggactggagcagagaaagttttcactggccactgcggcaggccttttccagtccctggtgggtctggtgctggtgctgattacgaataagatcgctgttaagatggatccggacagcggaatcatgtaggaggagagagtatggcacaggtaaaatcaaaaaagagagtatcaggcgaacgggccggtaacctattgatcgaagtgattcttttgttgatggtagtaaccaccctatatccgttctggcatgtattcatgtattctatttccgattccagggcggccatgagcggaggacttttctttcttccgagaaagcccacattcctgacgtatcagctgatatttaagacttcccagatttttgtggcctttggaaacacggttgcaaagacggtcgtgggcacgtttatcagccttgttcttactgtattgaccgcttatcccctgtccctgccgtactttcggggaagaagattctttcagatcgttatattttttacaatgctgttttcaggcggaatcattcccacgtacctgcttttaaaggacctccatatgctggatacgttctgggtctatgtacttccgtccgccatgagcccttataatatgtttatcatgagaaatttttttctgacaattccagactctcttcaggaatcagccatgcttgacggagccaatcatatgcaggttcttagcaggatcgtgcttcctctttccaaggcttccctggctaccatgaccatgttttatggggtaacgaactggaactcctatatggatggcatactgtatgtcaataaccagaagcttcagctgcttcaggtgtatttaagacagctgatttcctccacgggagcgaaaggggcattgagtgcggccggggatttaagcgccgcggcggcggtgacagaggaaagcatgaagatgaccgtgatttcgctttccattattcctattttgcttgtgtacttattcctgcagaaatatttcacgaagggcgtgatggtcggttccgtcaaaggataggtgcggccataaaaataaaagaacaatgaaaggaaggaaagtatgattatgactgggagaaaaggaaaaagaattgcttgttccgtactggcggcaatgatggcattgtcccttgcagcctgcaagggaagcggagggcagccggatacggcaaaaggtacgtcagacagcgctgcagaagtatcagatgcagcatccgggtggacctctgacaatggcgcagagatcacgatcatgcttttcggagataacactccggatgcagataatattgtaatacaggagctggaaaaaaagacggatacaaaaataagcatcatctacctgcctgaaagcgattacaatacgaaattgagcaccatgatcgccgccggcacggtgccggatattttctggtgcggtaatcttgcggatgcggccgactataagaaaaatgggattttggcgaatgtggaggagctgctgtcccagaaggcacccaatgtcatggaagatacaaaggatatgatccgtaaggtctctgtaaatgaggatggaatctatctggtgccttctcctgcaaagaactgggccaataatgtgaatatccgcacagactggctgaagaatttagggcttgagatgccggatgacctggaaagctttcgtgaggtcatgcgtgcatttacctatgatgatccggatggaaacgggcagaaagatacgtatggatatgcatttaatttaaataatctgacaaacgaggacggcagagcttttcaaagcattttcggagcctatggaatcccaaagggaaagaccattgaactggaggatggcacagtcaccacatgggtaaagcatcccagatttttagaagcaattgcctacatcaaaactctgattgatgacggccttacagaaccggattatgtgaccattccccaaatggatatgttcggaaagctgtggaccggagtggcaggctgcatggagtgggaatgcgtgggtcccaccaataactggatgccggtccgctatacggaggaccccgtacctgtttttggattccccgttttaaaggggccggatggaaaatccggagtgccggcagtctatccggaattgacctcaggctgggtgttttccgcctccagcaagaacctggaaggagcggccaggattgcagactactgcatgagcccggaaggaagcgatctcctgttcctcggggtagaagacaccatgtaccggtggaccgatcaggaaaagggccagtttgaatatctggaccagtataaggacaatgcgacccacagggcggcaggcggcttctgctactggctgctgtttaaaccatcagacaacgcccagtaccgcacattaaacgagcagacgagagagggagtgaaccaggcctgggaccaggggatcgactgggcctatgtcaccgccacgtcagaagtgagagtggaaaacggagcggatatggaccaggtcataaacgaaatgcttgcggacttgctgacgacaaaggatgacatcaagaccgtatttgataattatatggaagaatgggaaaatgtaggcggaagcgactgggagaaagaagtgacagagctctggaaagagcagaaccggtaaaggagctattgggaatggaagaattatatttagaccttggggcccttcccgtcagacgtggagcggggaggatggagccggaattgaacccgggagagctggtggtatccccggatcaatgcgggttcgtggagatggacttaatgagtgaagacgacgtccgcatatggagccggtattcttatctggttttggaactgaaggccgggatggatgccatggcctgtgtggatctatgttttttcaaaggagagggagagaagccggacaatgttttaagctaccagatgattcccacacaggatgtgaccttactggtggacttttctgaattgaaatccgtcaggtactttttaaaaacaatgcccggaatgttaaaagggcactgcacagggcttccggcagaactttcagagatgaaacgggtcacggttctggttcatccgggctatagcagagaattttccggcatcaggctgaaagcagcatacttaacagataccgtgccggatatccgggtggaagggcctttcatggtggatgagtttggccagtggattcaaaaggattgggatacaaagactcactcggaagaggagctgatttcttacttaaagtattcctatgaaagagcaaaggcagaatctgattatccggaaggcttcagccggtatgggggctgcaaggccgtagtttttgagaagacagggtacttccgcctgacacatgcccatgaccggtggtggctggtggatcccgacggatacggttttttttccaatggagtatgctatggttccagaatgggcgtattcggctttgtggacggtatggagcagatgtattcctggctgccaaaggaggatgatccggtatatcgggaggcatggaccaatgccggtgagatagcggagtatgtaaaacgcaacggaaaggagtccggcaaaaacagaaagatgtttaattttgccagggccaatatgatacgggcctttggacctgacaaatggtgggaggcctggcataccataaataccgccaggctgaagcggtgggggtttaataccataggagtgggtgtgaataactattttgatgagcgggtcatggaatatctggaaaaagccaacattccctttgtatggacattgaaggaatttcctcagacaaaagaaaagatcttccgtgatttccccgatgtttactcagaagagtaccggtcggaggcggaggcctttgccagaaggcaaatggcaccgtttgcagataatccctatatgataggctatttcatcaacaatgaacccgaatggaggtttcaggaggtgaatctggctgaacggactttttcccatccccaatgcctggagagcaaaaagaagctggttgagctgctaaaggagaagtatgggacaatagaggccctgaatgcttcctgggatgtaaaaatgtcggcctttgaagatttatatgtccccagagaagctcttgatcagtggtcagacggtgccggggaggacttccgttttcttcacgatacgctggtggaaatgtatgaaagtgtggttgcagaggaactgaaaaagagagattccaaccacctggacttaggaatgcgatattcgaaagcagatatcagaattatgggaggctgccggcaacacgatgtattttcctttaactgttatgaagaggaaccggagtccagacttaaactgtgcagccaaaaggaagatgtgcccatgcttatcggagagtggcatattggaggaggggataaaggcaatttatctcatggacttttggcttcccccaatcaggaggagagaggaaaggccctggaatactatttgcagagagccatgagccataagaactgtgtgggagcccattactttgagatgaacgatcagcctcttttggggaggtttgacggggagtgcatggagcacggcctgatcgatatctgcaaccgccagtttgagccgctggtatcccatttggaacacacaggccatcacatgtatgaatatgtgagaggcataaaaacgcccacgaaagtcaggggaatcatggagcgcaatgagtgaatcagaagcagacggaggaagtagaattatgataaaaataagcaaccggtacatggcaatcgggattgatgaaaaaggcaggcttgcatttctggaaaactgcagcaggggcaatgtgatcgacagaccggcagaggatcttttcatgatgaatctaaagcagggagagtgctgggaaaatcctgtttggggccatgaccaaagccctgccgtgacagagtgtgaaggcgccatagaaattacctattccagcctgtttgtgaatcatacaaaggaatatgccgatatcgggctgaagctcatcatttccctgaaggaggagctgataaggtttgatgcggtcattgaaaacagaaccggggattgtgaagtgatcgacttcgaatatccaaggatcggggtcataaaatccattggcaatcagccaccatcccttttatggccggtacagtcaggaatgtgttatcccaacatcggggagtatttaagtgacctgcccttaaccagggaaatatatcccaacagcatttataccagattcccgggcagcgacggaagcatgcagtggatggcgctgacaggaggagaggagaccctttatttttccggtcatgatgaagaatactattcctctgtgatgcgggcacagggaagcggtacagacaggggagccataaccttgatatatgacaaattggcatttgtcaaaccgggggagacctgggcatgtccgccttacgttttaagcctgtacaccggaagctggcggcaaggtgcaaaggagtataacagttgggcttcctcctttagagtgccccgggaaaaatcgaaatgggtgcaggatatgcagggatacttcctggtgatcaacaaacagcagttcggatatgagatgtgggattacgggcagctgcccaggctgtatgagctggcccaggcccatggctgcgatacgctgggacttttcggatggtatgaaagcggccatgataatcagtatcccgatttagaggttggagtgtctatgggaggccgggaaaagctgatggaaaacatcggaaaggtcaaagaggcagggggacatgtaaccttgtatcagcaaggtcacttattggatcctacggcgaaattctataaaattaaggggcataagctggaatcgaagagccgcacaggaatgccttattacgaatactactgtaaatctcacaaaagctcctttttaggctgttacaccaacaagctgtttaccatctcctgtccttcctgtcctgaatggcaggaactgatggaggaaaagacagattttgccgcttcctttggccctgacggtgtcttatttgaccagataggcggaatgcatccttacccctgctttgatgaaagccatcctcatgaaaaaggaaagccatccctgtccttaagcggaggcagaagacagcttctgcccagaatccgcagccgggtgaaatcatacgggcaggaatttgcctttttcagcgaacacattacggatatctattccgtttatcttgactgcgtacacggtataaactcgcttccctccgaagaaggagacagaaaagccgccgcagaaggagagcgcttaagagatggaatcaattatccggagctgttccgctatacctttccggagaccatcataaccatacggaacagtgcgcctttcatatccgtaagaaaagcaaactatgcatgtacctttggcttccggttcgaaatggaaatccggtatcaggatgactgtgacgatatcctgacagaccgctggcccatagaacgggagtatgcgaaacaggttacggatctgcggaaaaagtattgggatattttaggccacggaatttttacagatgaagaacatttaacaaaccgcaatcctgcgatcattgcaaagggctttcaaaaggaccgtgcgctggcagttgttctgtggaatgatacaaaaggcagcgaagcagtctgcatggaagcggcaggtttccggttaaaggaggtatccggcattcacggaacgggagacgggcttcccgatcggatggaaagccaggaactgctcatagctatatatgagaggatataagatatatgtaatttggaggacggtgatatcgccgtcctcaagccatatctccataagcttaaggaaacccaatcctatcatattatactcactgctaaaaactccccgataattactccgccaggcacagaatgggtgtaaagtttgacatgttacaggttccaaaggctggtttggcattttccagtgttgtggcctcttagaattttagatatatacgatgcaccgcacgctttgcgaatagtctgtcataatcatggcagtcgaagttgtggtgggggatgtgaaacattaggcccaatggaataacatcacaacaatatcgccaaagtttacagaaatggcctgtatagttaagaaaattaagtcatgaccgtcaaaaacacaaagctggcaaaatcacttgaattttaataaagtaaatgttataatcctaccaacatatcagacgagagaacaatggagtctcaagcgtacacagtacggttgcggctctttttgcttatgggccggctattttccatgcataggatccaggtccataaagcaaataaagctcttaaggagaacaaggaggttttccctgcattttcagggaagcctccttgttttggttttctatttgtttctgttcgtttgaatgataacagattgaggaggaagcgattatgaaaaaaagatttttagccgtaactcttacggcagcaatggcggcagcacttcttgccggctgcggctcttctgctcagcagagcgctgcaggtggaagtacaaccgcagccggttcggaatcttcccagggcgcagcgccttctgcggaagcaggggacgggaaaaccattaagatcggcgtgtttggtcctgtcacaggaggttctgctgtttatggagaaggcgcacagaatgccattaccatggcggttgaagaagtcaactcaggtgattccggctacaaggttgaaatagtaaacggcggaaaaatcgtagatgacggcggggatgccaagcaggcaattaatgcttacaacagtctgatgaaggaagggcccagtgccatagtgggaagctttttttcctccgtcacccttccggttgccgagcaggcttccaaagacaatatgctccttctggcaacaggagctactaataaagatgtaaccttaaaaggctccactattttcaggaattgtttcattgatccgtatcagggcaaaatggccgcacagtttgcaaaggaaaagggctggacaaaagctgccattatttatgccaaggatgatgattattccaacggcttaaaggacgcatttattgagaatgcggaggcaaacggaattgaagtggtttatgtgggagaatgtaccacaaaggatacggacttttcttcccagacttcccaggcggtggcaaaaggagcagatttcctgttttatcccgcattccttgatacggttccccttttggtaggcgcggcaagggatgcaggctttgacggagccattatgggcggcgacggctgggatggtacggatacggcaggctttgaagataaatttgagaactgctattttaccaaccactattcttcagaagataccgctccggctgtagttaatttcgtatcaaaatatacggaaaaatacggtacggaaagcttgaatgcctgtgcggctctttactatgatgccatttacatgcttgtggaagcagccaaaaacggcggagcatctgatacggcttccctggtaaagggaatgacgggaatgactttcacaggtgtgggaggaacctttactatggatgaaaatggtgatccggagaaatccgtagcgatcaatacctttgaagccggaaaggtgaaatggcttatgaccctttcaccggaaggaacaaaggaataaatcagcataaatcttacaggaaggtctgaaaaaaagataaggagatgtgcataaaggcttgaatggtctttagtgcacattttccttttgagaaaggaagatcctatgacattttcattattctttcaaagcctgataaacggactgaaccagggcgctatttatgccttgattgctcttggctacaccatggtgtacggaatcatccgcatgattaattttgctcatggcgattttatcatgattggagcctatactttattttataccattcctttgatgatccatgcaggaatgcctgcatggatttccgttttcttagcagtggtcatatgcgggctggtgggggttctggttgaggtgatcgcctataagccggtccgcaaggcaggctccatgtcggcccttattacagcgcttgccatgagtctgtttcttgaaaatctggccatggtcctctttggcgccaagccccataatgtccagaagatatttgatttgccctctgtaaacgtgttgggagtggcccttcccttaaatgttattttaactatcggtatcggagtggttatgatggcaggtcttcagatattcataaagagtaccaagatggggaaagccatgcgggcagtgccccaggaccgggatgcttccattcttgctggaatcaatgttaataaggtgattaccatgacctttgccatcggttccgcactggcggcagttgcagcccttatgtactgtgccaaatatccccgcgtcaccaatgacatgggctccatgatgggccttaaggcctttattgccgctgtccttggaggaatcggaatcattccgggagcaatgcttggagggattctggtcggtctgattgagatatttgtaaagctttttgcaccaggctggtatgaggcgattacctatgccattctcattgtgattcttttggtgaaaccgtccggcattcttggcaagaatgtgggcgagaaagtgtaagggggtgaattatggaaaaacggtttaaagtttcttatttccttaatttccttggagttgtggcagtttttctcctgtttgtcctgctttttgaaaacaaagtttttggtatgtccacccagtatatcaagggaatcagcacaacagcctgctatacgatcattatggtggcttccttaaatctggtggtgggctgtatgggtgaattttccctaggccatgcagggtttgtatccgttggggcatatgcctcagccatagtgtccaatggacttgccggaaaaggattgccggatattgccttattcctgatcgctcttctggcgggaggaattgcagccggcatgacaggagttctggtcggaattccggccctccgtttgagaggggattatcttgcaattgtgaccattgcctttgctgagatcatccgtgttcttttctgcaatctttctattaccggcggcggaaagaccatgagcggcattttgaagctttccaacttctactggagcttctggattatggtgatctgcatcactgtcatgtatatgtacgtacgcagccgctttggcagaacggtgaaagccattcgggaagattacatagcggcgtctgcatcgggaatcaatgtgacttattataaagtacttacttttaccgtagccgcattctttgcaggaatcggcggaggagtttatgcccattacatgacagccatgattcccacgaattttaacttcatgtactccgcagagcttctctcagaggtgatcatcggaggaatcggttccattaccggctccattatcggagcggcttttctttcttccctgccggaaatgatgcgccagttctcccagtaccgcatgctggcatactctgtagtattggtactggttatgatctttaagccgggcggtatttttggggcatgggagttttccctcattcgtgtatatgaacggctgacaggaaaaaaggatgaatggaaaaagagtcggaaaaaaacggaaggaggtgtataattatgacaggggtagaaaaaaccatgccggtattaaaggcgcagaacctaggaatccagttcggcggtttaaaagcggtggacagctttaatatggaaatcggagaatcagagctggtagggctgatcgggccaaacggtgcgggaaaaaccactgtgttcaatctgatcaccggcgtttataaacctacggaaggatctttttatttaaatggtcagtgtatgaatggaaaaaagacctatcagatcgttgaagcagggattgcaagaacatttcagaatatccggttattcaagaaaatgaccgtaattgataatgtaaaagcagccatgagcgccaagctttcctataacttatttcatgctgtttttcgtacgccgtcttactggaagcaggaagaagcgctgacaaaaaaggccagggaacttcttgagatcgtgcatctaaggggaaaagaggattatgaagcaggaaatcttccctatggagaacagagacgtctggaaatagcaagggccttggctacggatatgaagctccttcttcttgatgaacctgcggcagggatgaaccctacggaaacggaagagcttttggaaattatcaactatatccgggatgaatttaagatttccgtgcttctcattgaacatgatatgagcctggtcatgaaaatctgtgaacggatttcagtccttgatttcggcaccaccattgctgccggaactccggaggagattgccaatcatccaaaggtcattgaagcctatttgggaaaagacgatgaggaggtagaggaagatgcttaaggtaaaggatctggcagtatcttacggagccattgaagccattcacggcgtatccttagaagttcatgacggagaaatcgtttctctcatcggtgccaacggagcaggaaagaccaccatcttaagaaccatttcaggtctaaaaaaggctgacaagggagaaatcaactttgacggagccgatttgattaaaacagaaccaagtaagatcatcaatttaaagctggcacatgtgccggaagggcgtcatatttttccccagatgacagtagaagagaatctggaaatgggagcttttaccgatggaaaagacatggcggccaatatggcagatgtatttgaacgcttttcccgtttgaaagagcggaaaaaacagctggcaggaaccttgtccggcggagaacagcagatgcttgccgtaggccgggctcttatggcaaaacccaaaatgatcctgatggatgaaccgtctatgggactttcgccattgctggtaaaggaaatattttctattatcagagaagtgaataaaaagggaattaccattctactggtggaacaaaatgcaaaaatggccttatccgtatcaaacagagcatatgtcatggaaactggaaaaatcaccattgaaggcagtgcaggagatttactaaaggatgacagggtgaagaaagcatatcttggacaataggagggtacgactatggatgagaataaaaagtattttgccattgccattacccgtacctgcgggagcggaggcggaagctatatagggaaaaaactggcggctgattacgggatcgatgtctatgacagaaaactgctgcgtctggcatcggaagacagcgggatcaatgaggcgatatttgcaaatgcagatgaaaacacgaaaaagacctttttataccgtgcctcaaaaagagtctataacggtgaagtcattccaaaggaaagcggtaattttttatcagatcagaacctttttaattaccaggcaaaggttttgcaggagcttcttcatcacgaatcctatgtatgcattggccgggcggcggattttgtcttaaaggatgaacccaatgtagtgtccgtgtacttagatgccccctatgaattccgcttaaaaagagaaatggagcggcagggaatatcccagccggaggctgcaaagtatatagacagactggataaatacaggaattcctattacgtgtaccataccggaaggctgtggaagaatcctgaaaattatgatctttgcctggatacggaaagtctggggctggatcattgcgtggaattaataaagaaatacgtggagctgaaatttgggatcagagccaaggaaaaggagatattatgaaagagcttgcttattatgatggaaggatcggaacccctgaagaattgatggttccctttcaggaccgggttcatttttttggagatggagtttatgatgccaccgttggggggaatcacaaagtatatcttttaaaggatcatctggaccgtttttattccagtgccaaagccctggatattaagattcccatggaaaaagaggagcttggaaatcttctcaccgagcttctttccatggtggaaggggatactcattttgtgtactggcaggtgacaagagggactgctcccagggatcatatctacgatgaggcaatgcttggaaagctatgggtcatgataagacctaataagctgaaggatccaaacgtggccatccgcctgataacaaaggaagataccaggtttttccactgcaatatcaagacattaaatcttctcccgtctgtgattgcttctcaggaagctttaaaagcgggagcagcggaaactgttttacacagaggggatgtggttacagaatgcgcccacagcaatgtttccattttaaagaacggaacttttctttcccatcccaacgataatctgatccttcggggattgcaaagactcatatgattcaggcctgctacaggcttgggatccaggtgctggagcgggcttttaccctggaagaactgatggctgccgatgaggtcatcgtgacctcttcatccaatttctgccttcatgctggcttcattgacggaaagcctgtgggaggaaaagatccggaaaccttaaagaagattcaggatgctgttttggaagaatatttagagtatacaggcagaaagagcatatttgattaggagtgaatgatggacagaggcggactggaaaagagaaatgtgggagaaaacctggatgctcttatgaatttagatccaagaggttatggggtgtgccggattctttatgcagggagccgggagcagatgggggagcctctcaccatgagagcggcggaaaaactgtgtgaaacggtaaaggaaaatgatctggtttatattctgacaggatttgtactgctgcctcataagaagccggaaatggatggaatggtcagttctatgcttctggcacgggctctggttatggcttttggggcaaagcctgtcatcatctgcccggaggactgtgtgaaatccgtaaaaaagtgtgccggcgtggtaggccttcatatttaccaggatatagggactgtaagagagcttcctctcagcatgggagtgatggcctttacaaaaaatccggacagggcggaaattgaagcagaatggctgataaaggaaggacttcccggagcagtaatttctgtggaggccccaggttccaatgaaaacggtgtgtatcacaatgcagccggaaacaatgtaacggaactggaagcgaaaacagatgtgctatgggaaatactccggaaaaagggagtcttaaatattgccatcggtgatctgggcaatgaaatcggtatgggggcaattgcagaccatattaaaaaatacataccctttgctgcttccggagaatgcgtgtgcggctgcggaggcggaattctggcagccagcagagcggaccatgtgattacggcaacctgttctgactggggctgctacggtttgatcgcggctctggcatatttaaagcgggacatggaaattctccacagggaagaaatggaagcagagctgatgagagtggcgtcaagaaccggattgattgatatgaccggatctctgattcctggaattgatgggttcaacatccggctgaatacgggaattgtcagcctgatgcgccagtgtacggcttatgcggtgcggtattcccataattccgatcactggtttggctctgtactgaaaaaggggttttttgaagaaggagatggaccatggttcaaataaaggctgttggtgactgcggtgttctggcggagctgggtgattccatcaatgagtcagtaaattcaaaggtaatggaattaaaccggaaaatcagtgagctttcgccccaagggattcttgagacagtacctgctttttgttctgtacttgttttctatgatcctctgaaaacggattttgacgctgtatcaaaggttcttttaaaactgtcagaatctctggaaggcaaaacagggacaggcggaaagctggtggaaattccggtttgttacggaggcagctttggaccggatcttccttttgttgcagcccatggaaacttgacagaggacgaggtgatccgggttcactcgggcagggattaccgtatttatatgctgggctttttacctggattcccctatcttggcggaatggatgaaagcattgtcactccccggttaaagacacccagaaccaggattccggcgggaagcgttggaatcggaggagagcagacgggaatctatcccatggattctccgggaggctggcaattgatcggacgtacgccttaccgcctttttaagccggagcaggcgggaagacctctttatgaagcgggggattccattcgctttgtgcccatcagtcaggaagaatttgaagaaataagcagaaaacaggaaaaggggtgacgcagtgggattagaaatcttgcgtccgggagccttatctacggttcaggataaagggagaagaggctttttaagccaggggttccaggaaagcggagcctgtgataagtattccatgaagcttgccaatctcctggccggaaactttgaagaaccggaaacatcagcagttctggaattcacattaaagggcggagagatccgcttcacctctgatgagatcattgctcttgccggaggggatatgaaaccctgtgtaaacggaaacccggttcccatgttctccccggttctggttcggacaggagatattctgactatggactttgcggtctccggccttcggacctacctggcggtttatggaggaatccaggttcctgttgtcatgggaagccgttccaccaatttaaaatgccgaatgggaggcttagagggaagggcgctccttgaaggggaccgcctggagtcagaaaaaagccgcgggaagtttaagaaaataagaaagaaattaaaaagaaatgagaagctggcagccctggagaagaggaaccatggctgcgccgttcatcaacgccttaccgcttttacggaaatgaccgtatggttcttttgcgtgcagtagcaggccctcaggaggacgcctttacaaagctgggacttagcaccctggtcaggagctctttccgcttaagccgggactgcgaccgcatggcctgcaggctggagggagaagccatagaaatgaagaagggggctgatatcatatccgatgggattgcagaaggctcggttcagatctcatcttctggacttcccatggttatgatggcagaccatcagaccaccggaggatatgcaaaaattgccacagtgatcagcacggatatccctgcactggcacagctaaagccaggagaatcggtggcattccaatatgtgaccccaggtgaggctgtggcaatctgccggagggaaaatgaaaagctgaatcaattaaaggaacggcttatgaacgctgtttaccggtaagctgccataagacaggaaagaaggaaataacatgggacttgaatacaaagacagggaaccaaaagaagtccgccgtctgatcaggcagggcgtgatccaggagccaaccaccggaatgtgcggcggttatgcccagggaaatctggtgattcttcctgaagaactggcctgggattttcttttgttctgccagaggaatcccaaagcctgcccccttctggaagtatcagatgcaggaagcaggagttttcccctgacagcagaagagagcgatatcacaagggacattcccagataccggctgtatgaatacggcgtgtgcaccggtgaatacaccgatgtatcagaattgtttgaggagtatcaaagaaccaggggaaagctggtaagctttctcattggctgcagtttttcttttgaaacagcacttttagaggcaggaataccggtgagacagattgatgagggagtgaatgttcccatgttccataccaacattccctgcacaccggcaggcgtgttttccggcaccatggtagtaagcatgaggccaattccccaccgtaaagtttccggagctgttgccattaccgcctccatgccaagagtccatggggcgcctgttcacatcggttatcccgaagtccttggcataaaagatattaacaaaccggattttggcgacccggtgaccatatatgatggagaggtgcctgttttctggccctgtggggtaacaccacaggcagtggtcatgaacagcagacccccgtttgtgatcacccacgccccggggcacatgtttattacggatctgaaaaatgcggaattaaaaaattagaggtgagaatatgccggtcattgatttgaattgtgatttgggagaaagttttggtgcgtataaaatgggctggatgaagaggtgctgccctatgtgacatcagccaacattgcctgcggtttccatggaggagatcctctggtaatggaaaagacggtggctttatgtaaaaagtacggagtgagggcaggagcccatcctggattccctgatctggtggggttcggaagaagaaacatgagcctttccccaaaggaagtaaaagccagtgtcatgtatcagatcggcgccttaaaggctttttgcaacggggccgggatcaggctctgtcatttaaagcctcacggagcattgtacaatatggctgcaaaagattatgagctggcaaaagccatttgccaggcagtaaaagaagtggataacagcctgatccttctggctctcagcggcagtgaaatgctccgggctgcaaaagatacaggactgttagctgccagtgaggtatttgcggaccgtgcctatcaaagtgacggaagcctggttccacggagcagggaaggtgcgttaatcgaagatgaggatctggcggtgagacgggtgatccgaatggcaaaggaaggtgtcgtggagtccattgacggaagtaccatttccattgaggcggattctgtctgcgttcacggagatggagtaaaggctttggaatttgtgaaaaagataagggaaggccttttgcaagcgggaattgaggtgaaaggtttttagtggtcaataaaaaggcgtggcacggaactgtcatgccttttgttagtctactggtgcagtacttcaggtgctgcagtagttggaaaaagttaccggatactctatgattactttttatcagggaaaattaaattgcatcagtctgaaaatcatggtattctgtaaagagtgtcaggtatttcatcaaactaaggccaccggtgaacgttgtgctatagatactcagttgatttaagagggggtaaactatgcagtcagatgcactttatttacatgtgtaccaaaagatcctggatgggattcgatcttttgagtatgatgaaaattcaccattgcctgccgagcgggtgatatgtgaaaagtatcatgtcagccgggctacagtccgtcgggccctggaaaaattaaaggcagatggatatgtctacacgcttcccaataatggttcatttgtcaggccgcaagtgtttgagcagccgttgacaaaattttattcttttacaaatgaacttaaaaattccaatattgttatctataaccacattgtcgaatatgaattgatccggattgaccatgccctggcgaaaaaattagcatacccccaggggacgatgttccacaaacttgtgcgcctgcgttcagcgaaagaatatccgctgatgttggagacaacatatctgcccctggaaagatttcacactatcgatatctcatttttggagaaccgtggttctctctatgagtatttaagaaatacctatggatttcacatggacagagccgttgaatcttttcgtccggtcaatcccaatgccagggaacgggatttgcttaatattcctacgacaacaccctgtatgttccttgagcgtttcagctatgaaaatcactccattatcgaatatactctttccattgtacggggagataaatactcatttacggtaaatttaacactatagatccaggggtttaaggaaaaaaatatatgagccttagcaggcggcttgcataatcaaatgttgattgtgcaagttgcctgtttttagttagtaccaatctatatattgggctttatttagattatttgttgaaaaataaattaaaataggataatatgacggtacaaacaaattatttaagccggcatttgtttgaagtgtttaaaagagttaatgtgtgcactaaaacgcatggatgggagtgaagatatgggagaaccgaacattttgttaacaagaattgataacagattggtacatgggcaggtaggtgttacatggacgatgtctctgggggcaaatctgatcctcgttgcggatgatgaatcatcagaaaatgagctgtcccaacagctgatgaccgcgacggcagattcatcaggtgctggtatccgctttttcacagtcgcaaaaacaattgcgatcattggcaaagcatcagcaaagcagaagatcttcattgtctgcaagacaccgcaggtggtgcagcagctcattgaaggtggggttccgattaaagaagtgaatgttggaaatatgcactttgaaaaaggaaaacgtcagatcagtaaaaaagtctatgtaaatgatgatgatatagcaagtttcgctgcgatcaaaaatgccggtgttaacctctatatccaggatgtacccggtgatccaaagcaaaccatcaatctgtagaaggagaggaaataattatggtgattacatttggccaggggattggccttgcgctaatgacagcaattgtaggaattgatttttggctggagagctttttcatcttcaggccgattattgtatgtacgcttgccggttttattttaggtgatctgcagctggggttaatggctggcggtatcacggaactggcatttgcaggcttgacgccggccggaggtacacagcctccgaacccaatcttagcaggagttatgaccgtagtcctggcttatacgacaaaggttgaggcaacagctgcgatggcgctgtcattgcccttcagctttttaatgcagtatgtgatcctgttttgttattccagtttttcattgtttatgaaaggtgcagatcgtgcagcggaagaagcggacacggataaaattgtcaggattaatattatctgtacctgtatcattacatttttatatgcattggttgtattcctcagtgcttatatcgcccaggatgcgatgaaagcattggtcacagcaatgccggaatggctgacacatgcatttgaagtggcaggaggcatcttaccggccgttggttttgctatgctgttaaaggtaatgctgaaaagagaatttatgccttatctgttaattggatttgtgatttcctgtttccttacatactccaatttattgcctgttgcgattgtcggtgtggcatttgcactcatgacttataacactgaaaaaggtaaagccgtgatgaaaactgtaagtgtagtagaggaggacgatgaagatggcatctgataacaattccagcaaagttataacaaaacaagatatcacaaagctaggccttctctcaacatttttgcaggccagttttaactacgaaagaatgcaggccggcggctttttagtatcccagctgccgcttttaaagaagatctataaagatgacaaagagggcctttcagcagcgatgcaggataatttggagtttattaacacccatccgaacttagttggatttttaatgggactactcatctctctggaagaggctaaagaggacagagccaccatcaaaggtttgaaagttgctttgtttgcgcctcttgccgggatcggtgatgcgatcttctggtttaccatactgccgattatggccggaatctgttcctctatggcactgaacaacagtatccttggtccggttttgttttttgctttttatttgatggtattcctgctgcggatcgtctggacccatctaggatataatcttggaacaaaagcaatcataacgatcaaagaaacgtccacgctgatcggtaaagcggctactgttctgggctgtaccgtgatcggcggattgatcgcatcctatgtaaatattacgctattaccggaaattgttgtaaatgaatttacaacagtctcactacaggcggactttttagataagatattccccaatattctgccatttggctatgtcttctttttatactatttgctggtgaaaaagaaaaccagtcccgttatcctgatcatcagtacatttgttttatcgattattttatcattcctggggattctgtaaaaacatgggtaataagataaaaatgtttgtcagcgatatggatggcacgttgctgggacttgatttccgaatcagtgagaagaatgccgccgcgatacggagtctggaacatgccggcatcgagttcgtgattgcaacagggcggatctattgtgatgcttatgaaatctgccgtcaaagccagatctatccggctattatttccaacaacggtgcatgtatatttaatagctgcaaggagcagatttatggccgctggtttcccacagaaggcctgaatggaataatcaatttcatggaagaacatcgtatctgctatgggatcagtacgagcaggagctatctgatacccgaaaactgggaagatctgctggataaagaatcggaaagcctcaagcaaagaggttctctggtctcaccggcccaaattacctatatgagggaagaaatgctgacccaggtgggagttgaaatcgtgcctgacctccgcagttatttcgcagatggaaattcttgttatatgatttcagttcatacctttgatcctgaggtgattataaaagtcagggagtttatcagtggatttgataatgtaaccgccctgttatctactgatcatacggtggatattatcgggcgtaattgttcaaaagctgcggcacttaagtatctcacacaattgcggcatttgagtagggaaaatgtggcatcaatcggcgatggaatgaatgatatttctatgcttcgggaatcagctgttgccatgtctccggccaatgcagcgaatgaagtgagggcaatcagtgaatttattaccggaagcaatgccgatgatgctgtggcagatgcgatacggtatattaccgccaactattaagcggattattaattggaaaagaggcgttttatgacaggctttttgatcacaggacatgggaattttgcatcaggaatcatttcagcggtcgagttggtggcagggaggaccaaccggctggttggtgtggatttccttgagtcctacagcacagatgatttagagggaaaattacttaatgccttggaggaacttcagaaggattatgaagaaatcctgattttatctgacctgacaggtggttcgccttataaccagtcggtcatgataaaaatgaaaaatccccaattaaatatagaggtaatatctgggagcaacttccctatggtgattgccggtatttttgagggagagggtatgacattaaaagaacttacacacagcatgattgtcaagggaagagaaagcattaactgctttgtgcccgcaccgtctgtgaaaacaacaaataatgaaagggaagatggaatttaattccaatcaaggtgattcaaatgctcacgctgcaggaaatcagagaacaatatacatccatgggacagacaaaagagtatctgtctggatacatagatacaatcaagaagattttggatgacaattcagatagcaatattatctttttgggctgcggatccagctattccgtagcaaaatcctatgcccagaatactatgacaggcttaaagcgggtcggtctggcgatggctgccggtgacgtgctcattcatggagaccgctatcaggcgatttttgaaaacgccatcgttgtggccatatcccgttccggtgaaacaacggaaatcattcaagcagtgaccaaaatacgggaaatctgcaagatacaggtgatttcgattgtgtgcaaagaaaattcaacagccggcaagatcagtgatctcacattgacaatgccctgggcttttgataacagtgtctgccagacaaggacggtctcctgcctgtattttgcatggctctacatagtcggaatgttatcagaaaatcaggctcagttggcagaactgcaactggtggtcagccatggtgatgaatatataaaacagtgggaagcagagctgaaaaaaatggcggcgcttccatggaaccatgccgtcgtattgggagatgccgaactcagtggtatttgtgaagagggttctttaacatttaaagagatctgccagctgcccagtaactattatcatatgctggattcgcgccatggcccgatggtgatgatcggtaaagaaacactggtcatcatgcccatgtccggtcattctcctgagctgcagaaagcattgctggaggatttaaagaaaaaaggtgctgctattatcgtatatacaaatgaagcgatggagctggatggtatttgtaatatttattttggcagaaacttgagctatccggtaatgggcctgccatttctcgccattaaccagctggtgtcttacttcaaatctggagagaccggggcgaatcctgatcagccggacgggctgtcaccatggattcagctttaacaggggtgcgtgagggattctatgataataacagtaacattgaatgcatccgttgacaaggcgtataccatcagcggcagtgtagagccagggtcagtcatgagagtgattgggtgccgaaacagtgccggcggcaagggtctgaatgtggcacgtgtggcaagtttgtgcaaggttccggttaaggcgactggaattgtcggcggatataatggtgactatcttctggaacttttggaacatgatggcgttgcccatgatttcttccatgtcgatggtgaaaccagaagctgcatcaacattctgacggaagataatacttccacagagtttttggagccaggttttgaggtgacagaagcagaacagagggagtttctgaactttttccgtaatgttatacaagagggaagtattgttaccatatccggcagtgtacccgtaggctttggcaaaggaatatatgccgatttaataaaaattgccaagaaagccaataagctggtattgcttgacaccagtggagaatacttaaaagctgcgctggcagcaaaacctgatcttgtaaaacccaaccgcgaggaactggaggatttattcggctgtaagattgattccattgaggatgtcaagatctgggcacagaagcttcatgatatggggataaaatatgtgctcatatctttgggttctgacggcgcagtgttggtctgtgatgagggagtctatcatggaaaaccgggaaaaattaaagctgtcaatacagttggctgcggagattccatggtggcttcatttgcagcggcattggagatgaataaagcttctaaggattgtctgtcatatgctgtggcagtctctgctgcaaacgcattatcaataagaacaggatattttgaacaagagaacctggaaacaatcctggacggtgtaaccgtgagcaggatataaggaaagagggaatatatgcctttagtaacaactagtcaaatattgtcagatgccaggaacggtcgttatgcagtaggggcatttaatgttgaaaatatggagatggtcatggcggtgatccaggctgccgaggagttgaatgccccagtgattttgcagacaacgccttctactgttaaatatgcgggactggacttgtatctggcaaatgtaaaaaccgcggcggagcgggcaaaagtccccgtggttctgcatctggaccatggatctgattttagactggcaatgcaggcactgcggaccggttacacttcgatcatgatcgacggttcccatgaagcttttgaagcaaacattgaactatccagacgcgttgtcgaagcctgtatgccttccaatataccggttgaagcggagcttgggaaggttggcggcaaggaggatgatttagatggaggcgaaggcagtgcctacacagatccggaagaagcgaaaacgtttgtcgagaagactggcgtgaactcccttgcggtggcgattggtacagcacacggtatctacaagggcgaaccaaaactggatttggagcggttatccgaaattgccagggcagttgctataccgctggtgctccacggtgcctcaggtgtgccggatgaaaccgtgaagatggcaatcgaacgcggcatatgtaaagtgaattatgcgactgaactgagaattgcttacagtgaaggtgtaaaagaagtgctgaaggagaacccggatactattgatcctaaaaaatacggttcagccggtatcagtaaagtaaaacgatttgtgaaagaaaagatgacaacctgtggctgcgcaggaaaaggctgatgatttgaaaaagatggtatatgtgttagaatagattctacgtcagtgtgtgcaataaaagggggatgccggaaaataaggtagtctgagaacagggaccgtattactcacattagttatacggtccctgtaaatttgtgcgctcggctggacatcacggatttgcggagtgggccggacgtcttttttattgaagcacgcaaatggtattgattcattttcaaatgaatccgcataataattcaaagaaccaatggaatggtattgacacagagagaactcatgactataatttgaccaatacaaaggcgtggcaagaaactgtcgcgtctttttctgtatatatcaaaaaagcagaaagccatcatgcaaaaaagatatattggatgatatttgtacattatgcacatgaaaatgaggagaaaaaataaaaattaattaatattgacatataacccatcgtgtggtaagttaaacgtaaataaagagatgcgagagataacagatggctaataagatacaacggacatcccttcagttagagattattcgttatatacagaattatattgaagaaaatgatttaaaagcaggagacaggcttccttcccaggaacagctgctggaaatgatggggtaagcagaacttccttaagagaagccatgaagaccctggaggcgcgtaatgttctggaagtgaggaatggaaagggtgtgtacgtaggcagtcagaaggacagtgcatttttatcactgattgattttaccaaggaaaaaggaaagcttttagaagctctggaagtgcgtaagattctggaacgtgaaatcctccgaatggtgatacatacggttaccgaagaagaactgaaagaactgggtgatattaccaaggtattaatggaaaaatatcatcagggggtaaggcagacagaagaggacaaactgttccattataccatataccgtttgtcccataatgatattatgtatcagttgattttgtccatcagccatgtaatggatcagttctgggaatttcccctcaatatggaagatccttttttagaaagcctgccattgcatgaaaaactgtatgaagcgatccggggaaaaaatgtgaagaaagcacagatcatcaatgaacaattgttagatgcagtgtaccgggatattaaaaagcagatataatgatttataatacatcaaatatgttttataacaaattaacctatattatagcatatagcatataggacaaagaatcaaatgagaaaagaggtagaaatatgtcagatcagagccgttacttaaaaagtgataaattaattacagcccattacggagaggaatatgagcattactataatgcggttgttccgccgattttcatgaattcccttaatgtatttgaaaccatagatgaatactatgattttgaccggacggataaacacaaatattgttacggcagagtacagaatcccacagtcaggattctggaagataaaattgcggctttggagcatggagcaggagccctggcatttgcgtcgggcatggcggctgcaacaacagcagtactgaccgtatgcaaaacaggcagtcatgtaatatgcatccataattcctatggtccgttaagagattttctgaccggatactgcaaagaacacatggacatttccaccacctttgtaaagggagactgtttggaggaatttgaagaaaacataacggacaaaacagacttaattgttctggaaagcccttcttctcttgtattttccctccaggacattgaagcggtctccaatatcgcaaaaaaacatcaggcccttgtctatattgacaatacgttctgcactcccatttaccagcagccccttactcttggcgcagatattgtaatgcacaccacttcaaagtatattggaggccacagtgatatcatcggaggcatgctggcagtgaaggatcctggtttgatgaagaaactgacagcaaacagggaactgttaggcggtattgcaggacccatggaggcctggctgatgatccgcggacttcgcacaatggctgtccgcattgcacagcatcaggaaacagcgatggcggtcgccaggttcctggaaacccatcccaaagtaaagaacgtgtattatcccggtctggaatctcatccccaatacctgctgatgaagaaacaacagtcaggaaatacgggacttttaagctttgagattcatggaaccttaaaggacgctgaaaaactagcggaaagccttcggatatttaagatcggtgtatcatggggagggtttgaaagtctggcatttttaccccatgcaaggatggaagaggatcgatgcaaggttttgggcggctcccagaagattatccgaattcattgcggattggaaggtacagaggccctgatttcagatttggaatcggctcttgctcaaatataagcaaaacaaataaaaggaggagaaaagatgagaaaaaagagagcagcagcattggcgctggcagtggcggcggttctgtcaggatgcagcggaaacacagccacagaagcgacaacatcagcaagcggggaaactgcaaagacagaaagcaccaaggaagacagcggaaagacgggggaaacggtcaccatcagcctggtagagtccctgacaagtccggaacgaacggttattttacgggaaattgcagataagtatgaaacagagcatcccaatgtcaagattgatattgtgtccccgccgttggagaatgccgatgccaaaatcacccagatgctgatgaatggaagcggtgtggatattgtagaagtgagagattccacaatcacccagtttgtcaccaatgaatggattgcagatcttcagaaatatttggatagctggtcagaaaaagacactttgacagattcggccaaggaagtgatccattatatgaaagacggagcttacatggtcccttatggattctatcagagaggtctttactacagggccgactggtttaaggaaaaaggcttgaagcagcctgaaacctggcaggacatttatgattcaggggttgccattacggatccggcaagcagccgctttggttattcgttccgcggcggcacaagcggttaccagtatgcggatacaatctactggagctggatcggtaccgataagcttgcagattccaatgccggttattttttaaaggatggcaatggggcaaccatttttacattgccggaggtaaaggaagcacttcatttctataaggatctatttaaaaatgcatctcctacggattccatagcatggggcttttccgaaatggtacaaggctttgttggaggaaccacctctatgctgattcaggatccggaagtgattgcgacctgctccgctgatttacaggatgaccagtgggatctggttcccttccccaagggaccatccgggcaggcagtttttccaaacggatttgccggctggggtatgacatcctttacggagcatcccgatgaggcagcagatttccttttgtacttgtccaattccgagaataatacatattttgccaagaattattccaccattccgattcacagcaacgcggcagaaaaagacagttatttttcagaggcacggtttgccatgtatatggatatggcaaaagaaccggaagtttaccgtcatgcggcatatcctcagatgtacgaagcatttgctacctataaaacagaagtggataccatgtatcagaagtatttgaccgacgagatcacagatgatgatctgttaaaatggctggatgaattctggacaaaagcatatcaggatgaaggtcagaagtggtaagcattaagaaataaagcgctagacaggaattaaattttcataagaagtttctggaaggagaaaggtctccttccagacttcttatggaagaaaggcagtaaagaggaggaagcggtatgaaacaaaaatcgagactgcaattaaaaagagcctgttttatctttcttatggttcttcccgccgtcatcattcctattatatttacttactatcctatgatcaggggttccatgatggccttccaaagctataacctgatgaatattaaaaacatcaaatgggtgggatttgataattttaaaaagctatttgaacacagtgccagcaacaccttctattccaccatgtggaataccgtcaagtgggtggggatttccctgtttttccagtttgtaacagggtttgccatggcactgctcttaaaaaagaagtttaagggaagcggtgtgtaccagggcctgatttttttcccctgggcagtctccggatttattatcggaatcatgtggcgctggatgtttaacggtacctccggcgtaattaatgacctgctgatgaaattgcacttgatccgccttcctgtaggctggctggcaagtaagaatacggcgctgtattcctgtattatagcaaatatatggtatgggatcccattttttacaatcatgatcacggctgccttaagaggggttccggaagaactatatgaagctgctgatgtggatggggcaaacccgtttcagaagttttccgcaatcacagtgccttgtatccgttccgtgttattgctgacggttttactcagagtgatctggatctttaattttccggatctgatttattccatgacacagggaggaccggcgggttcttccaatatcatcacttcctacatgatgcagctggtccagagtctggactatggcatggcttccgccgtgggtgtgctgtgcatcctgtttcttatgatatttgcttcgttttacttaacacttaccaaatatacggataaggaggcatgacgtatgactgcagcgagtaaaaaacagatgtggagattatttaagtttgtcgtactaactgcctttcttgtgctgaccatgttccctttcctatggatgctgctgacttccttaaagggatctcagggcgagatttacgcattcccggtgaaatatttaccggatccggtctctttggtcaattacgcggcaatgctctggaaaggtaattttgcaagatatttatgcaattcattttttacatcttctgttgcagcagcctgctcggttttcatatccattctggccagttacgtcatcagcagattccgtttccgctttaaaaatgtgctgctgctgttttttctggtgacccagatgatacccatgttcatcatgctggcgccgttgtatcagatgttaggcaagatgcggatgctgaataatctgtatggcctggcaatgctgtataccaatatgatgataccattttccgttgtgacgttatgcggcttttttgacggagtgcccaaatctctggaagaagcggcatggattgatggctgcggctatttgcaggcattgtttcaggtgattgtgccggtcattatgccaggcattgccgccacattcatctttgcgttcatcaattcctggaatgaactttttatgtcggttatgtttattgatgtggacaaatttaagacaataccggtagggcttaatgccctgatcttaaaatatgatattaaatggggggaaatggcagcaggaaccattatgtcattgatccctaccatgtgtttgtttacttttgctcagaaatatatgatagaagggcttacagctgggtcggtgaaaggctgataacggaaagaatagaataatgaaagaagatcaaaaggaacggtatcatacagttcctttttggttttttatgaatactgtataggggataataacagccttattttcgcacgatcgatcgattgttatagaaaaaactaattcagctaaaccggaatacgtattgacatagaattttgttaaatctataatggtatcatcggtttaatgtataaaaatttatggaaaacagctgttgtgacgataattaaaatagggagaaatgctgaattaattttaggaaaaaacgtcttgtactggactgtaatatgttaagaaggatattggccataaaattgttcatagtttgatagacacaatgtccggcatacgcgccgggccgcaaagttttatttacaggggaaaaagattgtgattgagattgctgtttgtgatgatgagttttacttgttgaaaaggctggaggaatacttgctggaacttgggaagaatgccggaattcaagtagaagtggagtgttatgaagatgggagcgatctggttcaggcggtaatcgaaggaaggcggtttgatataatctatttggatgtacggatgaaatatatgaatggcctggaagcggcatataaaatacgtgaaatagaccgtacagtacagatggtgtatgtaacatctcatgatggctacatgaaagacgccttccgggtagctccaattggttttcttacaaagcctataaaaaagaatgaatttgaagaaaccttttattatgttttaaggattgtggaagagcaggattcgtattaccgtttccaatataagaaatcggattataaagtgttaatccgtgatattctgtattttgaaagcaagcttcgagtggcggaaattgctttgcaagatggtcttttaaaagaatataaagcattgaataagatagaaaaaaatctggaaaacagcaaagggaaatttttaaggatacataaatcatatctggtaaattaccagcatgttatccgtatggggtatgaagaggtggaaatgccgaaaggaatcatcttaccattaagcagggcgtataaaaaggcggtggatgataaattgaggcagtataaaaagaggtaaaaaatgaatgcagtcaagatgattttcacaagcattagcatgtcattgtattctacgcttttactgaaagtgtatctggatatttttcttgcaaagaaaagccgatatgcgggagtggccggctgggctcttttttttctatggcagttttgcataaatatggaattgatatatttccatcccgtaataaacctgatattgacattaacgacagttttgtcagttggcattatttcttatgaaggaatcttgtggaagcggtttacatttcctataacttttgtaatgatgtggatgcttttggagggaattggggatgcaggctatttatttttgaataatgggcaaaatccatcatttatgattaactctatttttgcaaaatttttactgttcttaatagtgatgggaatccgttggttcatgaaccgccatggaggcggaatggttccctatggcggaggcgcctatttaaccatttttttgttatcaggactgatcctgtatcccgtattttatatgctggtagaaacgtcggatagaaaagtaacggattcctttggctggctgctgatggctgcattgatattaacaattatgaatctatccatttatcccatttatttaagattagtggaaacgattcaggtgaagagaaatgcccatatgtatgtaaagcaactggaatactatggaagacagcatgatttggaggaagcagcgtcggcagaaatacaggaaatgaagcacgatatgaaacagcgcttaatctatttgcaagagcttgtgaaatctgaccaaaaagaaaaattattaacaactttggagaatttgataggtcagtcagtgagcattggtcgattggagtcaaaaacagggaatttaataatagacgctatggtaaaccatatatgggaaaaaaccagtaaaaaagagatacgtttacatacaaagctggaagtacctggggttatgaaaattaaagatgaagatcttggggtactgctgggaaatgccttcgataatgcggtagaggcctctgagtatgtagaaaaagataagcgagagatctggatagagataacccatgaaaaaggatatttgtatatttttgttagaaaccgctatcagggaaaaatagagcatgataaggaacacaggctggtaagccggaaggaagagtcttttcatggctgggggatttattcgatgaagaagattgcaaaaagataccatgggcaagtgaagctggattgggaaggagatatattttcactggagactatattatatgacgatatatagctttatttaataacaagaacgattgtatgaaagacgaaatgatattggtgcataagccggatgtcatttcgtttttttattgggcgcaaggatactgcaaaggctttacttaaatttttattcaaaaataaaacctaaaatgacatataaaccgttaataattacatgataggaaaaaatctcgaaaaatgtagtatattgtaaaaaaagcatagaggaggctatattatgggatttatgaaaaagcttaaaaggaatcattcagtgtttaattttttaattttatcggtaattctttatagcgcaaatgctcgttgttgctggatatctcatcagccaaaaatgacagaagatgttagaaagtttaagaggttttaatcggtgaaaaggtttgaactcatgttggcaaggtatgcatataaaagagatagcttatcatcagtatcatttgaaacctacgaatacgcagcacaggtgacattagaaatgctgatgggggtattggcaaatatagcgatcgcactttgtcttaatatgaagctggaagcagttgtgttttttttggtattctgtgtgttgcgttcctatgccggagggttgcatttggacaaattcagtcattgctttttgttttcctttgctgttacgacaggatccatgttgcttgtaaagtacatgaatgtatcacttgcggtatcgggaatcatgatggggggaggattgatagccttttggcttacaaaacctgtgaacgataaaaacagagatgttaatgaagaagaagatgcttatttcaaaagtaagttaaggcagtctcttagtatcattacgatagcttattttacaacagcgcttttatcattcttaaggtattcctttttaatcgccttgacggtggatgttgtgtacatacttatgattttaggaaagtggaaaaataaaagcacggtatgaatgctgccttatgagcagattgatggtattaactgcattacacggaacaaaattctgagaataagacaaacaagaaaagaccataggataaaggtgtgtaagaatttatgaaaaggttcaagacagtttcatttttattaagttgtctcttttttatttctatctcgttttgttcgtctggagaggaaatagcaagtgggaaaaacggtctggatgtcatgtttgtcatggactatagcggctctatgtctgccaatgatccggatcacactgccatcggtatggtaaaagcgtttattgatacagtccacagtgctgatatccgaattgggtttgtagcatataatgaccatattgtgtcatctgcggctcctgtttctgtgaggactcaggaagagagggatgcattaaaagctctgatggattccgccggatattcgggaaatacggacattggtttaggattgaactatgcatatggtctgaccggacaggaaaacggacgaaagtgcatgattgttctaatctcggatggagaaacggatttaaaaggttcccgggccggaaggaccagagaaatctctgatcaggacttaagaaatacggtagaggcctgccgatcccggaatataccgctttatacggtggctttcggcaaatatgacggcagcaaagagattctgaaggaaatttccagccagacaggaggacaaaattatacggttgaaaagccggaaaccttgattgaagtactgtatgggatttttcatgacaacatggcttaccgtattcaggaaattgcgggcggcatttatggagaaggcagccagagccttcgcattaagcttgatgattctcatttagatgagatggacgtcctgatgatatcgcctcagcaaattggagatactacggttgtttacggagagcagcagataaaaccggttaatctggttcactattctgtggcaaaagtatcagacataaaaaaagatatcagtgaaatgaacatacagaccaatacaagaaagaatcaggagctaaagatttatctgatcagctaccgggacctgactcctgttatggaaatagaaacagcaattgcaagaaacaagccattgtcttataagatctattttaaggataaaagcgggtctgtgatcaaggacgaggccttttatgcgaacttcactccaaaggtggtgatttatccggacgggcagtcggacagtgacagaagggatgttgaaaccaccgtcaaggaagggattcttgcaggagaaatggtattaacccagtcagggacttattacatagaagcccgtttggatgacaggatggagtcttgcatctttaatacagtaagaattcaggtgattaacacacctcctacgggagaacttccaaagaacattcattataatcctttatccagggaaaaacagttggtacttaacaattattttattgattctgatggagacggtattttttatactttggaacaggatgccggtgatctggcagaggtcggtctgaataatggaatccttactattaaaccggtaaaagcaggaagccgaaatctgatactgaagatatctgatggagaggcagcaatatcctatacctattccttggagataatcccattgtggaaagcatactggtgggttattgttctcgttctggcagccgcaggtgctgtcatttggagactgtttcataaaccaaagcctgaactggaagtgattacggaaaagaaagctcagaaccgattccagggaaaaatggatgcctattttatggagcagccggaggaagaagaggagatacctcctcttacatttcccatgtataagatcaaggataaccgggtaagccttggagacttaatgaaagaatatccaggcgcttctgaatccctgggactggatcacatattcctcatagcggatgaagacaggaggatgattttgtatcattcttcagagtcttcgcttatgatcggaagttccattatgtgcaaaaagatacagtacagcgtaagctttggtgatatcatatccattacatctccggatggagcttatgatctggagattcactatatttccatgattcaatagatgaggctgtaacagcctgagataagaactgtgatgttcacgtttcccgccagtaacagctgatggaagcgattgaataaaagtgagaaagagggagcaaaagcgtatggaaactattacacaaactaaccggaccattctgttttctgaaatgaatcctgaaaagctgaatcttctgaccctgattggggatgtaagagggaagacaagccttgatgatgacaaaattaaggaaatcaatgaaacgcttctggtagaaagttttgaggattttttggagaagtttgctccggttgtttattcctggtgtgatgcaaataccggcagtattcagtacagtctgatcaaaccggagaatataccggataactgcattacagaaataccgcttaatgagatgaatgatttactcaacatgctcattacattacaggatgcaagaggttcgttgggagtagcaaatgtggattttaaattcagcaatgttttagagatgatctcccctaaaaagattatggaagatatccgtcaggtgcggagagagatccaatatacttatgggaattacatggggctggaggaggaagatcccaagcgccttgatttaggggacaagctgaattaccagtttgaacaggcaagtcacaattacaataatgttttggctatgctccctcttgcgattgaagatatcaagacccgcctgcttctgggaaatggggagactgcccaaagaggccaggaatttaaagctgggcttttaagtatgggagacgacggagaactgaaaatcctggaaatgaaacaggaagaaggaactcagcttgcgattgtagatgaccacatcaataccagtttaattcagacattccgggatgattacgatgcccttaatgagaacaagtccgactatgtcagagagctggtggtcaggaccttctgccccctttcttccacaatggaaagctccgtagaccgggaggtagaagtacaaaattacaatacctatcttgaattttataaaaagagcaaggatgattttataagagcggtaaagccattgattgaaaaaatcctgggtgtaaaggcgtactttgaccagtacaaggtaaaagagaagggaatgcagccaaggctcctgattacgaacactcctttggaaatgatgataaaatccagcaatttgccaaggcttttaacctatttaaatacgacaaatgataaaaatgaatttgaaaatactctttggtttggaattgttccggatgtagaactaaatcagacaggagatggtaagcttcagagaatgcggtttgcaggaaatcagaaagtaaaaaaaccgggaaccaataccatggaaaaccttgcaattttgatgaatgccattaacccctataagattacaacatttttcagcttcgctaccggagaagagagtacgtttaattatgtggctactgagggaattggtatttttaaggataaatgcgctcctcttatgaagagagattacagtgaatttgtagttccctgcattcccaatgttaccatcataccaaaggataagtcaggacttatcctggataaacggatggtcattgatgacaatggaaatgtgactctttcccaggaaaaagaggacattatgaagatgtggatcgagggagtatatgtgggagctgcctacggggctgccggtatcgctgcagcatggcagtgtccggaatacctaaagcagaggtttcctaataccaccatggaatacccgggagtgcgttatgacatagaagcaggagacaatgcacttttagtcacgaccagcatgacaaaggagatatccggatttaccaatgccattaaaaattccattaacaatacaggttttggatttgtattcacctctgataatgctcagcataaaggcagggagattaagaatgtcatggtctacaaagccagaaatttattaagcaatgggacggaatttgaacccatttataaaacccttctggttacatatattgagagaatgctcagattttacagcggagacttcaaacaggataagattttacagtttttcagcaataaccccagcagccagaagagtaaatgggatgcaaaccgtcagtatgtcaattccctgctccaggatggagatgagctggatttcagcattgatgagaaaaacggcatctgcaacatacagctgacgttcagcaacacaaccagaaatcttaaggtggagctgacaagaaagggacagactgcgtaaataataccaggtattgtccactcacaatcatatggaaggtgggaacaatcatgtatggaaacgtcagcacaattgtgacaattatattttttgtaattgcagggtatacaatttataaaggaatcagaaagaaatacaaataaaagctttatttcaaacatcagatatccgaaggccagtattagaaaggctttatggattataaaaatcatttattaagaatggaggacgtaatatgggacttagaatgaaaatcacaggcagtgaaaccgtacaactgcgcgaaacgagcattaccaatgtagtatttggagcagacattccccatgattccaacgccagatcaacagatcttggttcaacggtgttgattgaagggaagatactggcagcagtaggcggtgaggccgccgatgataccagcaagctggccagatggtctttagttcccgcagaaaattcagactgctaccggaatgttcagatcgacgtggtaaatgcatcccaggtggttcgtcagataacggtacccaatgcatttgtggttgattacagggaagattttaccgatgaaacgggaaccggagtatttaagcttcttattaagcagaagaaggataaaatggcttctcttaaatttgaaggcggattcagcggagaataatcaggaagaataaaagaaaggaaggaacagattatgggatttacattaaaagtagaaggcccgtctaccattgacttagggaccatcagtattacaggagtaaagtttaagacagatattccccttgattccaacgcgcgttccaccgatctggggagcactgtggaaatttcaggaaagatattaactgcagtagatggagatccttttgattctacaagacagttgggactctggtccttagtaccagcagaaaagtctgactgttaccggaaggtgaccgttgaggtgattgcagcttctcaggtagtgagaaaatatacatatcccaatgcgtttgtagtggattataaagaaaactacggagatacggaaggtgtaggaacattccggctcatcatcaaacagaaaaaggacaagatggcgcagatcgctgtggaaggcggatacagcgtgtaaacatgcaggggctgccgaaaaggcagcccctttttgataaggaaagaaaaaatgcttgattactataaaatccttggggtccttcctcaggcaacagaaaaagatattaaggccgcttaccgaaagctggctaaggaatatcatccggatgtggtacaggatgacccggatggaaataaaaagatgtatgagatccaggaagcctatgggattctgggtgatgcagagaaaaggaaacagtatgattctttccgaaaagaaaaaaaggaaagaggaacggctaaaagggaagactcccgggaacaaagagagagaccgggaaatgcagctccggatatgagccagtttgaacgcttctttggatttcagccgggaaaagggatggagacatatcgcggaaccggggatggggcgaaaaaacatgacggaccagtcaataccaatgagctgttttctgcattttttggcgtgaaaaaataaggaaaaagccaacggtttttgacggaagaaaatagggggaacaggatagtcaggatcttcaaaggagggaaaagcagatggaacggctggacattgatttatatttagcctgtatggagaaagaagataaaacagaaagcagtgaagaaaaactgaaacaaaaagcaatggaaaaaatagaaaagctccatcaggaactccagaagataaaagaactgaacatggagcggacagtattctttggaaatttattttctatctgccttcccaagaatcttctcctaaatgaaattacggaagaagatgttatattattgcgttctcagtctgaacatatggcattggtgattaaggctgtggactgtaagaagccgattgatttagaacatgtgaaaaagaattatcaggaacagatgactatgtcaaaacagcaaacatggtttgatatagatggaagtaaagtggtggatggagtgaaaattttttattttactgcaattcattctatgccggaacaaaatcagataaactatatccttttattctgcctggataataaaaccgttatccttgattttaatatgagggaagaaagttactcattttggaaaaacagcattgctgtgatgatgaaaacgatacaaaaggcaggaggggattttgatgagaaataagtggaaaaaagggctgtgtctgaattttgctgtgatgatgatttttgtatttacaacagtttttttatgttcctgtaagaatttgtatagagaaaccaataagggtgtgaactcagaagcgcaaaaagtcctggaatcggttattgaagaaaatggcggtgttgagccggatatgagatattcgacaggagaagtgtcttttaatattcaccttggttggaagaaagttcgggattctgaatgcttttgggatagagaacgtaccaatgtttatggcttgaatgccagttctccgcttggttcttttacaccagaggagtgtttttcctttttggtcgaatattatcaggaggaagattattttaaattgttggatcaaagtgaatctctgacacaatggtattccgaagaaaaagtactctgctacttaggaacgattactggggagatggaaggtggatatacttatacggaggttgttattgcgccgcaaaaaaatcttgttcttacttttgtggggcagacttcttatattgatatagataaggatacggaatcgactattaaaatgaatgtaacagaattaagggaaagccttatgtttgaaacgggaaatgctgattatgtaagcggtaatacatatttatatgacgacggttctgagctatgcctgcatgacgacgggacatttgcctattacgaaaaggaagaagaacatgaaaagcaatatctggcaggaacatatgaaactttttacggtcagccggcatttgatcaagtgacatccatggaagaatatggtcttgagaaagaggaactggagcaaatgctgtctgcaaatatgaacggatatatacctgggggaagcaggcccatagattatatgtatgcgacaaacccggatatgaccgatacacggcctcggtaccagatatgcagggatacattttatgcggttgtttttcataatatgatatatgtcaatacagaaggagagcaagaggaaattgagaaggattctctttatataggattttacattcctgaattgaatattatggatatgacaaactgcaatgcggctgctcatgcaacgtgggcttataaagggaaaacggaatgatggtagggaacgcttaggcagataataatgggaggggaagaaggtgtgggatggataaggattccatcaaaagcagagtgagacgtgaaataatgatgatgttgattttgggaattggtgcatggattgttcttttgatctttttaagctgtaaatcattaactggcggagagaaagacacttatgaatttttgtcagattctgaggtcttatctcttctttccgataaatatgatcaagaatttcagattattaatacttttaatttagatgaattattaaaagatagtgaaataaaactgaaagtacatggaaacgctttgctgcatggttatatatggcagctcgcaccaattaatgatcgtgaatacactttttttgtgatggattacgaagcagctggacctccatcaccgattcctttttcttctggttcaaaatattctaaagccattgatgattttcttgtagaaaaggtaaaagatgattttcaaactgttgccttagaaaatggattgctctttgatgaagttaagaattatatgattgatgaagaaagatgggaagaaaattatcagttaggaatcctgccatttgctaatccgcctatagaaaatattaagtttgatattcatgtgacggatgaaaataagcaggaaattgccgatagcttttttccgtgtttaaatggtttggcagagcaacgatatacttatagcgataaagtcgaaagagtaaattatattcatattactggtaacgatggatgggaatatgtagatttaccgtacaaagggaatgaactttttgatacaaaagataaactaattgaatttttaaaatctataacgatagatgaaaaggaatatatggaacgattaccagatccgtttattgattttatggaccgttttgaattgtatagcgatgtttttaaacaaataggagctgatgcaaaaattgaaacaaacagttatggttatacacgtttaaaactgatactttcaacgggagaaattgtatattttgatagaaagaccaattatgaaaagatatcggagcgtagaatagacaaagagaaaccatatacagattcagatggaacagtattgcgggcaactctaagaattcaggatagcatttatcaatcggaaagtaccaaagaaaatctctgctcggtatatttagctttgtatgatggtgaaaagattaaatacgggcgtggtacaccgtttgaactgccatattttgataagtttatgagggatacggtaaatcattatagtgaagaagaggtacgagattttgataggtatataaaaatattcactgctgcagaaatggaagagacttatagacgaatgcagattttaaaagagcaaatgcttcaggaatttgatggtcgccttcaacttattaagtagagggcaggcagaagtaaaaagtgaaagataataaaaacggagaatttattttagaacagtattggtatggaactggttccggatcaccatttccatgagtaggatggggaacagaaagtgatatggattttagttttcatgtatatgtttatcctgaatcattggaaaaaagtctggatattaacaatgtgaaagagattcaggatggttattgttggaagtatataaaagaaaaaattaaagaggcaatgaaggaaaaatcgggaaaaatattagatagagagtataaattatttatcagaacgagcggagatgattttaatagtcaactaacagcaaattcaactgtaaaagattatcttagacttgctaaatttagtcccaatattaaatgtttatatttgtaaaagtcagtaatgatgaatcagaaaaaaaaacaaaagtattttttacaattaattgctcattttaaaaagattgaaaatgaatttgaaataagttttgactattatactgtaaataataatgatgattttgattcaattaatgtagttaaagaagaaaatggacattttgccgggcatgatagaaaatgggaaacttggcaaaatccaatatgggatttaaagatgaaaaaaatttgggattgagattgatactagaactggtaaagaaacaatatataattttatcaatgatgatttagaagattataatgatttggaggaagttaataatgaatacgattgaagataaagatgctgcaaaacaaacgagtttgatttatggaactgctatgggcgcagattggtatagtatggagggtgagaaaactgtagaaaatttagttaatgtaatggaagaaagtgtgaagaccgattctaaatatttcaaaagagataaagatggaaatataatatatggcggagaaatgaccaaagagaaattcttagatgtcatagaccagatcaaatcctctgaaaccttaatgaggatggaaatcaaagatattacagacaacaaagatacgaattttcgagtcataacacttgaagatcctgaaaaagatcctgaaaataaagtaaaaccaatcattgtattgtaggggaagaagatgtgggatggataaggattccattaaaggtagagtgaaacgtaaatactgtagcagatttaatagatgaaatggaagaaagtgtgaaaacctattcaaaagatttaacaagagataaagaaggaaacataatatacggtggagaaatgaccaaagaagaattcttagatgtcatagagcagataagagcttctgataccttaatgaggatggaaatcaaagatattacagacaacgaagatacgaattttcgagccatgacacttgaagatcctgaaaaagatcctgaaaaaaagtaaaatcaatcattgaatttcgtgatgcggtcagccagatttttatgaaaaccgggagtgataaaaacacggagaacttattttagggaagatacctaaaattataagtttattacaactgtgaaaggtgagaactgatttttaagagaggctggtaaggggtgaataaaatgttgaacaatggagtaaagattgcaattatatgtggattgataatcagtggttttattcttacatgtgcaatattttcctttggttcggataaaaagcggttgagcgacgacgaaaaggacgaaataaggcaagaggaattgaggcaaatggtagaaaagcatcttgaggataaatatggggagaggtttattgtagaggaagggtggcatgggacagctgcaggcgacccgcttccattcccgaaggatacaggcgatccatggtattgtattgcttatgcggaaagtgacctagggtttggttttcgcgtgtatgtctacccgaaagtaattggaaaggagcgtgaggtgaataatgtgggggaaattagggatggttattgctggaagtttctcagggaacagataagaaaagatcttgaaataggagtagacaaggcgatccccctggaatataaattggttgtcaatgcagattttgatactgtttttgacgatgatattcaacgagattcgtcaatagaatcctatattagaaacgctgatggaaataaaatagaggtatatttatacttaattatagataatgatatagatttattaaaagataaattatataaagtattgaaagagaactacgaaaagtataatggaacaataaaattttatttgatttgttataaaacagaagatgatttaagaatttttaatgaaaaaacaatggacgatataggatttacaagaaaagaaacagtttcttctttttgcaaaagtaaatggggattggatttagagatattatttagaatagaagatttttcttattaaaaagggggaaagtagcatgagcagtattgatgaatatgatggggccaatcttgcttcttttatatacgggggggggagatggagaacgtatataagactaaagaacctgaaaatatggcggaattcgtaaaagcaatggaagacaagattcaaacattaccatcatataaaataggcgaacaaatgaccagggcagaatatcagaaaaagctcgaccagatcaaatcttccgaagtattaatgcggatgaagattgaaaactttgaaaataatgaggaaacagattttcgtgccatgacattagttgatccggaaaacgaagtaaaaccaaccatcgtatttcggggaaccgctggaaattatggctggggagataactttgccgccatgttttcctctatgacaccgtcccaaagagaggcgaccaaatatgttgccaattcaggacatgatcatgtaacgttggttggtcattccaagggaggaaacctggctgccgcctgtgcatatgcacttccgcctggaatggtggataaggttaattcctgtgatggtcagggtctgtctaagacttttttaagtcaaatcagtggatggaaacagaacgttgccttgaaccttgttcataacatcaacgaataccgggatatggtcagccagatttttacgaaaaccaggagcgataaaaatacgatttactttgattggggagtggagtgttataatgctgaccttttgggagatggatttaatttaaaaatgtatttcttccatgtacataaaccgaattattttatcaaaccgggagtaacactggcggaccgtacttttgttccttcaggattgcaaatcagatatccatttggaatgggctggacgcattatcggaatcttagaaatgatgtgagaattgttttttcagaaaagaatggctggggtaaatagatgagaagtaatggaataaaaagtgcaatcattattattatgattattggtgtatttattctcgcaataacaatatttttttacagtccagacaggcataaggcaatacctgaaaaaagtgaaagtgaaatagaagtagaactaaaccagatggtggaaaggcatttggaaaataagtatggagagcgctttataatagtaaagcctcgttatggttctgcatggcatactaccacacagggttcccctgttcccggaggcagtgttggcggagaaagtggttttccaagatattgtatcgcttatgcagaaagtgatatggattttaaatttcgtgtatatgtttatcgggaatcattggagaaacgtctggatatcaataatgtgaaagagattcaggatagctattcctggaagtttttaaaagagaaagtaagagagtattttgatacgagaatggggaaatgattccagatgaacgtaaatggataattagtacattaggaagtattagatttggtgaatctataaacgaagattctcccatagaaaaatattttttgcaatataacaaagttaataaggtaactttatggataacattaattgtaaatggagaaagtgaaagcgatattttacaaaatgctctgtatgcggtgacaaaagaattttatgaagaatatgatgaggaggtagctattaaaatttcctgttttaaggtgaaaaaagcagaagactttataaatatggacggaacagaagaggaaaatcttaaattttcaggagaaggaaagtttgatacttggcgggaaaaattagaatatttatttagtataaaagattttgatactatgtatagagaaaatggagtataaaaaatgaagaatttggatgaaaaagagagcgcaaaattggctagtttaatttatggaacttcaatggatgtaaactgggagtcgttaaaagcggacgatgaggtggaagataagacgatagcagatttaatagataaaatagaagaaagtataaaaaattattcgcctgatctaacaagagataaagaaggaaacataaaatacggcggagaaatgaccagagaagaattcttagatgtcatagagcagataagagcttctgataccttaatgaggatggaaatcaaagatattacagacaacgaagatacgaattttcgagccatgacacttgaagatcctgaaaaaattaaaaccaatcattgtattgtaggggaagaaggtgtgggatggataaggattccatgaaaagtagagtgaaacgtgaaacaataatgatgttgatttttggaattagtggctggattatttttataatatttttttacagtccagacaggcgtaaggcaatacctgaaaaaagtgaaagtgaaatagaagaagaactaaaccagatggtggaaaggcatttggaaaataagtatggagagcgctttataatagtagagcctcgttatggttctgcatggcatactaccacacagggttcccctgttcccggaggcagtgttggcggagaaagtggttttccaagatattgtatcgcttatgcagaaagtgatatggattttaaatttcgtgtatatgtttatcgggaatcattggagaaacgtctggatatcaataatgtgaaagagattcaggatagctattcctggaagtttttaaaagagaaagtaagagagtattttgatacgagaatggcggaaaagattccggatgaacgtaaatggatcattagtacagttgaagatttaaggtttgatgatgatataaataaagattcttcattggaacaatatttttcagaatataatagcggtgaaaagatagatttatgggttaatttaattgtaaatggagaaagtgaagatgctgatttacaagaagatttatattctgtaacaaaagcgttttgtgagaaatatgatgggaaagtaagtatttatttattatgctttaaagctgaagtagcagaagattttattaatttatatgaagagaaaacggagaatctccactttttaaaagttaaaggatttgattcttggagagaaaagttcaagcttttatttcgtatagaagattttgatactatgtcatagaggatacggagaatataaatgaaaaatctggatgaaaaagagagtgcaagattagtaagcttaatttatggaacttctatgaataaaaattggaacacaatacaagataaaaagaacgtaaatactgtagcagatttaatagatgaaatggaagaaagtgtgaaaacccattcacctgatctaacaagagataaagaaggaaacataaaatacggcggagaaatgactagagaagaattcttagatgtcatagagcagataagagcttctgataccttaatgaggatggaaatcaaagatattacagacaacgaagatactaattttcgagccatgacacttgaagatcctgaaaaagatcctgaaaaaaaagtaaaaccaatcattgtatttcgaggaacagctggagattaccaatggggagacaactcggccgccatgttttcaacccaaacgccatcgcaaagagaagcggcaaaatatgttgcaaactccggtctggatcatgtgacactggcaggacattcaaaaggaggcaacatggcggcctcctgtgcctacttacttccggagggaatggttgacaaggtttattcttatgatgggcagggagcttccaaaacattcctgaatcagattggtgaaagaaaacagaagttttgtaaaagtattatttacaacatcaatgaatttcgtgatgcggtcagccagatttttacgaaaaccgggagcgataaaaacacgatttactttgattcgggagtggattattataatgccgatcttccggaagcaggatttgattttaagatgtatttttttcatactcataaatcgaattactttcttaaaacgggcctgacattgatgaaccgtacctttgttcctgccaggatagcaaatcaaatatccatgtggaatgggctggacgcattgccggaatccttgaaattaaaaatagcaaaaaaagttgctgggctgatgtatacgaatgaaagcgatatagggcagaaagaaacagagtggtcgaatgagagatgggaagcagttctgagagcggaggaagtttatgcaaaagtaaaaaaaagcagggaagatgaaatgtgtcaacgtttgaccgaattgtaccgtgtggatttctcgaaattcaagttggatcaggaccccaccagctttgtggtagaaggagccatactgacgtgtgacggctgtaacaatataggggaattaaaaaacattgaggatcattcaaatatcattcagggcaaagctgtcgcttcgaaaaaagacaataaggcagggacgaacattctcatagaaaacgcagagtgtatgttatgtgcagtagatgagattgaatcggtattgaaaaatccggagacagataaaaaaactctggaatcagctggaacagtaacatgcaagccggagatatgccgggaatgggtgattactgatcccagtatcatagtggatgtggaagggcaggaggtgcctgccgtactaaagaagtcaatgttaccatgtttaaaaggaggaattatcacagtggcccacaatggacagataattatgagtgatatagaaaaaatgtctctggaagaaagcatttcaaagaaatgggagcagactccaaaggcacttcaaaaagtggcagccatttataccagtgggctaaaaggtgaaatagacaggattattctgacaccgaaaaaagtgagaaataatataaaaaatcagattgatttaggcattgatatgggagaaactctgatgaacggctgcataggccttaaaaatggaattgaaagcggcatcgtaaaggttggtgaagccttggatgaggcaattcagcagttggaacaggcaaaggacaattatattcaagactatctctggaaacaggtacaggggaagtagaaaggagaaaacgtggaaaaaattggattgatcagcaatggcgaaatcaggatagaaccggttcattttatagaaataaacgagttgcagatacatagaaacataaacgaacacatattttttgaggcagttggaagaatcagtgaagaagaaaagaaacagtatgatcatggtctggagtttggaaccgaattgattgtaaagcatgaaaaaggacaagttctttttcggggattgcttacactggcggaaataaatcatcagggagaatgctataaccttcgggtacaggcgtattcccatacaatccttctggacatggctcctaaaacaagaccgtttcataacgtggaagccccctatgagggtattttccggactatcacatcagaatataaaaatgcggatacaattatccgtaaagaatatcaggcaaagaccggccagttttttatgcagtatcaggaaacggactgggaatttttaaagcgtcttgcttcgcgccaaaatcaggggattctggcagactgcatttcagggcacccggcttattacatagggattcctgagcaatatgtggctgtggaaaagtatctgggagaatatcagataacaaaggacctaaaagcttataaaaaagcgttggaagttttaacacccgctgtttctgatacaagctatattacctatgcaatccggatggatgaatgggtagaactgggagaggaaataaactgccaggggcagagcctgtatgtaaaatcagtacataccgttctggagcaggcagttctggttcatgattgtgaactatgcgtaaaagaaggattggcccaggaaaaaaagtataatgaaaagttatcgggaaaagcggtaaaggggacagtggaagaagtaaaacgggatctggtaaaaattaatattcagggagaagctggggtacagaatgcacagggaagctgctggtttccttattctacagtatatgcatcgaaagatggaagcggctggtactgtatgccggagaaaggagataaggtaaggataatattcccggattctgatgaaaagaatgcttatgcttccagttctgtaagtgaataccagccacagcccggggaagcagatcagatggaagattaccaaaggcggtatatccgaaatccgcaggggatggaactgtgctggacaccggaacaggtgagtatttcagcaaatggagccagcattgcgacattggaccgggatgggacattaactttttctgccagttctaaaatcattttgcgttccgaaggagatattgttatggaagcaggaaatcaggtaaaggttcatgcatcagacagcattcatatgatctgcggaggaaaaggggaaatcaatatcagtaagaagggtgtcatagaattgaaaggtaacaaggtgtataccaattaaatacaggggatatgaatggaacgggaaaaattattagaaacgtttaagtatggttatgtccttccggaaggtactgaaagaatgatggagttggacacttactgtaatgaaaacctggagctattgtgtgaaggacttcaggcggcattcaggcagttgtggaagcgtctggaagaaaaaaagcgtctggaacagaatatattcagcatcagcttgtgtgtgttaagaagcagattccttcaaagggatgggcgagtaagaatttatgcatttaatgaatcattttatctggattccaatgcgttatgggtggaatgggatgccagcgttctttttgattttttgtgggagatggaaaaacatctatgctcctcgttaaaagattttaaaaatataattaaagaaggcgatatacaggaaattcttcaaacagaatatataccatggataacccaatacataacagaacttaccaggttcgccatcagaaaaaagaagattgacctttcaccggtattatcccaggcagggcggttttgtgtgactgttggcgaatacaggggaatttttgacgaagtatatttagaagagaatggactggagaatgacctggatttgagaaaactcatggagactgaggaaatgacagagataggaatttatggcagaaactataaaaatcttcaatggcagggccttaaactaaaaggaatgaacggaacgaaaagtaatttttatcatatggatttttccggttctgatttaagtgagtcttatttcataaaagcaggattttaccactgcaacttaaaaaaaacgttgtggaaagatgcactgctgtttgaagcagatttttcagacagtgatttgtctggagcaaatttcagaagagccatggcgccggtcacgaaaccaggtttgtttaaccgcaatttgttaagcctggtgggggtggattttaccaatgcaaatctggaatatgtaaatttttcggaagcagatttcagtggagcagatttcaggacatcagtgcttcaatctacagtatttcaaaataccagattaaacggagcaaaattcagaagaaaatcattgaatcaaatagaacttacagaggaacaaagaaacagtattcagatttacgattaggagtgatcccatggaatattacatattgtcacaggaagagtcatatcacaatacagtttcttttgagaaagcccactttcctccagaactacggtctatttgcacgataaacaggaagctacggctggattttcagaacgtgccttttcaggaaaaaagctttaatcttagggtaaaaagcggggaggaaatctattatcctgatttgatagaaacacctctgttattcatttcagacaggctgaaaacagtatttttcagttatgaatccagaatacactataactgcacaatattgagtgatctggttcacaagagacaggaggtttattggctttgtgcgttggaagaagcagactgccttggtaagtcagcaaaattctatccagatcattctttgaaaaaactggttttggataaaaagaaaattggaaacagaaagattttttatatatcagggataagagaaaaccggattgtcgttcattttgatgtggtggagagtatattgcgcaggccgtttaccgggatatgcatgaaaaaagtctgtttggagggataggatggattatgaatataaaggattggaagtaacgatagaattggaattgcttcatatttacgatttatgtattttaaaagaaataaatcaacatgccagcttgattttacgtgggatatgtgaagaaaataatcatcaaaaaacaattttgcagacagatgaaaataaaaaaatagtagtgaaagatcaagataaatgcctgattttttgtggacttataaccaaattacatatggaagaaaaaggagaagtcggaatgtttcttttgaatgcagcctctttttcttatcagatggatttaacaaagcgaagaaggatttttcagaatttagagatgacttatcaagaagttttggaaacggtattaaaagcatatcccaatgcttcagtcactgacaggttgtcaggtaatcggaaaattcctcattttctcatacagtatgaagagacagactgggaattcatgaaacgccttgcatctcattttaaggaaggaatttatccgaatccttcttctaaagaaattcaaatttcgtttggtagaccgtttggagaatctattcgcaatatggaaggacaaccagagaaaaggatactggatattttaaagaagcaggaaacaatttggagtaattcctgtggaaagtatgaagtgggagaaacagtgaggaaccagaataagaattactatgtgaaatcggttcagctgctcactgagaaggaagaggttcagtatcacgtggagttggtctgtcacagggaatcagagtctccttatataccaaacagacagatcgctcatacaagaatgtgggcagaggttctggaagtacagagaaatcagcttaagcttcattttccaatggaagaaatatcaggtgctcttatgccttacttttcgtttgaagcaggacaaaataataaacttgggtattacatgtctgatcccggagcaaaggcagaagtttattttccggacgaggaagagcaaaatgggtttgtaatgtctgtgatcaggcaggaccagaaagagacatcaggtctgccgattcgtgttcagtccattggccatgagatggggaacggattccaaatgaatgaaaaaaacgttttattttcaacaacaggagagaataccacaatacggctgacttcagatggagtcctgcaaatggaatcttccggttctatgaaattatcggcttctaaagacattatactggaaaaagagtttgaccatttgcagataaaagctggaaaaggaattcagatgaaagcaggaacaaccggtaataatacaattgaaatggatgaatccggaaatattgagtgcagatgtatggggaatgtaatatacagaaaaacaggggaaagcagtaaggataagtttgaagaagaaaaaggaaagggaaatgcggctgaagtaagagatgttgctatggcgcttgcgggaacagcatttatttctcagacccttaccggaaggcaagactatactggtgcaggaaaaataatggatcattttatcggaacaaatattactgcagagggaccattggattcggaagagcaaaatcctataaaggcaggcctgtttcacaatgatgatcggctgtttagctccttttcctatggagagaaccgcaatgggacaaaggggaggtgaagatgagacagataaaacacaggagatcatcaagagccaggtatgagaaaataaggaggacaccagataaagcatggagagcagaagaaagatgaaaataggattggatatcaccatcctgatttgcgcaatatttttaattattggccttttttctaagggaaacgactggttgtggatcggggtgatgttttttgccgggcttgcagccgccgttgatctgtttggccggataagggaaaaggaggtcagggaaatgaaacaaccggaaggattcccggaggcggtcagggccactcagctcatgcttttggacgagcatgataaacctttgaaatcttgggatttaacaggaaaaacagcccttatcgtaggaaagaaaaatgaagaagaggatgtggatgtagatttggaggactgcgagtacagtgccttcattgacaaccagcatgcagtactgaattactgcctggattcctggtatttggaagatttaggttcacaaaacggtgtaagaatcatgaaggcagaggatggcatctgttatcaggtgaccggaaggccatgtaaaattttggcgggagatgtgatttacattgccagtactcgccttttattaacataaatacatagataggagattggaatatgagcttagtaagatgccccaatggacatgtttataatgcaagacgttatggtaagatatgtccctattgtcagatgaagctgaaagaggagacagaagagaagaaaccggtgggctttgagccttctatggaagttttgcaggaagaggtccggcctgtctgcggatggatcgtatgtatctctggtgcaagggttggaatggattataagatccacagcggaaagaactttataggccgtggtgatgacatggatatacaaattttaggagacaatgaaatcaaccggaaaaaccacaccatcattgtttatgatgagaaaaagaggaatacagtcatccttccgggggatgcggcagggcttgcctatctgaatgatgaggcagtttatgtgcctacggaattaaaaccttatgatgtgattgagctggggaaaagccggtttttatttgcccctttatgcggagaaaattttgaatggaatgataaaaaatgactgtgatgatcatgggaggtcttgggatcatgctgtcggcctctgtgctaggccggctggttctggcggccgcagatataaggatagaagaaaatagaaaaagagaaccttcagatgaaactgccgtcagccagaccaccggctgtaaggagatccaggcggatctggcgggaatccaaacaagcagcgcagggaccctggcaattttggctgatgggattggaaaagcaaatacaggaaaagtgtgtgccaggattgcagtagatactttgctggatcgatatcagccctgccatgtgctcaataaccctgaatatttctttaagactactttttgtgaagcaagtcagagaattcagaggaccataggggaacggcggggaggtacatgtctggcagcagtatttgtcaatggagggtctatgcattacggtctggccggagatatccggattgctttgtttcggaatcaggaattgatccccatcagcaaaggccagactcttaatgtgcttgcattaaacgcttatcaggaaggaatcttatcaaggcctgaaaccatctggaccatggaagaaaaacgggtgtggaactatctgggaattgatggatttcatgaaattgagattggagaaagacctatctggttaaagcctggtgatgtggtactgctcgctacaaaagggatttttgaagcggtatcctgggcggagatggaagatatcctgttaaaggatcttactttgaaggaaaaagcagacgccattgtcatggagtcggaaaagaaaaatgggatggaaatagaaaacgggagcgttctgcttctgagagcggaggtggcttatgagaagaatgaattctgattttcgtacacagtatatctcagaagaagggcagaagctcacgaaccgggattattttggatttgcagaaatggatgactatgcctgctatgtgctggcagacagcctggatggagaactggagaccaacagtgcaaagtttgttgtggaaagcctgatccgaagctttgtagagggacctaccatgaatgcagggaagctgaagcacaatatgaatcaggctcaccgtgagctcttaaaaaaacggggaggaatgcacttaaaggcatctgtcaccatggtggtcacggattacagaaaattactctgctgccatgtgggaaacagccggttttatctgcttcggaacggcaggatcatggtcaggacaagggatcagtcctgactgagaatctgctgaaagaagaaaggatcaccctggatcaggcggctgcccatgaggaaagaaataatctttattcttttttgggagagcgggggcagccggaaatccttgtgtcaaaaaagatcgggctggaagccggtgatatctttgctctttttacaagaggggcttgggagagctttggcgaggaagagtttctggaggctgcaaaggaagccaaggagcctaaggagatactggaccaggcagaggatgtgatcttaggacagcaggagacagaggaggtggacaattacagccttgcagtgacctttattgaaaaggtttaccagcctccgaagaagttgtcccttaaaaagattttaatggctgccatacccattgttttggtggtgggtgggatcagccttgggctttatctgcatcatagaagcataaagaacaaggaatacaatctggaaaaatacttaagcagcggtcaggaatatttgaaatatgataattacttaaaagcttctgaggattatggagaggcaaagaagctggcggatggcttgaagaaaaaagaggaatcaaaggaggcggaccagtataaaaagctggcagagcagatacttttagcggatgaggctatgatgggaggagaatatcagaaggcccaaaacctttacttaaaagccagggaactgtccgtaaaggcaggaaatacaggaaaagcatacatagacgccggattaaagcaaacaagagattatatcgatgtatttgacttaattgaaatagggcagcaaaaagagggatacggtgacatggacggagccgtgaaatcttatggtcaggcgagagataaagcggcagccctttatttttcatctggaaaagaagaggctttggcaaagcaggcggcggccgaggaaaaaatggagaaagacagtcagaagcaggaagctgcagaggcggcagccaaggaagaatcccaagcggcaaaaaattcggaagaagagtcaaagcaggcagaagaagaaaagatgaaaaaagaggaagaggaaaagcgggagctggaaaaccagcagaagctgaatgatcagaaaaatgccattgacctggagaataagggaaatgaacttctggcggaggaaaagtatgaaagcgccattacctattatcagacggccaaaacgatctatatccgcttggagctgtacgagctggcggatgggatcaacgataagattgcggcagcaaaggccggaataaagacaaaggatcagaaaacgtccgaatcaggcagcgggacgggaacagagaatggagatcctggaaaaaacggtccgggagtgggccgttaagctgccggaaaccatttatgggaaatacatgacaaagtgaggaatacaaatgagccgatatacctataccttacacccgggaaaaacagaaccggaaaaaaatacttataaaagaagcaaattggaaacgatgaccacctttcagcttaaggaaatctgccggaaggagaagctggtcatgccttccggaggctgcatggatcgggaagtacttcttcggctgatcctgcggttcagggggcagaaggattatcggcatattgatacagaatgcaaaggcgggctggaacgtcttcaggagttctttgacaggaatctcatagatatccgttccaaccagaaggtgagaattccgggaaccatagtaatttaccgtggaactggattaaatgaactggatcattacaaggtagaatcggacatggccttatatgaaggaaacctgttgctcgtagacgaaaatttcctgatttatacctgtttttacataaaagaggtggaaaataccttttatttgttccaggggaaagatatgcgggtcctgcctcttgggaagcaccagtattttattttgtatttccccaatgaacgagattcggaatttctttatgactgctatcagggtgatcactcatccattccgggccatatggatggaatccggattcctcttcttgatattgaggtacgggatgtagcggagacagatcttcctttggttattgactttggaagctccaatacgacaatggggatatgcctccctgatggaagtgtgaaaattgcaagggatggaaaacattctgtcatacccagtgtcataggggtggaggaatgccgggaaggcgggcacggattcaaatttggaaacgaggcacttgccatgggagaccaggggtacttagatgaagatgtccctgtgttctttgatattaagagatggatcagtgatgcagaacggatggaaagtgtcattttaaaaagcgggtttaaatatcagattcctcgccgggacatgctgaaagcatacttggaatacttaatcgacctggcgaaacagcagtttaaatgccagtttaagaacattcagtttctggcccctatccgccaaaaggagaagttccgggagctgtttgaggagctgcttcccaaatttcatgtaaactgtgagctggatgaagggatggctgtactttttaacagcatttacgggatggtaggtgagaatcgctatgagaaagggagatggtatcatgcattgatcattgactgcggaggaggaactacagatctgacctccgggcggttccgcattgataacagccgggtgtcttataccattgatttagaaacccgttatgaaaacggggatacgaattttggtggaaataatttgacatttcgcatcctgcagatgctgaaaattaagatttcacaggcattgggatatttggaacagggggattcctctgactcatctgacggaaattacgggcagaaactggaggaggattatcacagggcagaggaattccttccgacccggtttaaggattatgaggagaaaagcagggagcagtattttcatgtaaagaataactattattatctgtttcagcttgcagaagaggtgaaaaaatccttttttggatccgggttccagtatgagctttggattgaaaccagcagggaaagggaaagcaggggaatgtttttggataaatggaagctgtcagtacttgatgagggctgttttacccacattgaccgggaaatacgctttcccttgtatttaaatgagattgagacgattttaagaccggatatttatcatctgatggagcgttttctggatcagaaatttgaacagggagaattgcaggaatatgaaatgatcaagctgaccggacagtcttgcagatccagcttgtttatggaggctttgaagcagtatgttcctggtaaactgatccaaagtgcaaaaaagggagaggatgagtcggagcttaagatgtgctgcttaaagggagctcttgcttactttataaactgcaaaagaggctatatgaaggtaaatcaggattaccaggtgcggacccttccttatgaaatcgtggcacatactcatgagaatcaggaaaaaatattgatccgcagtctggatccagaagatcatatcggctgcatttcccgcttcatgattggaaaacagctggacctttacttaaatgatgataaaggaaaacgcttaaaaccctattactttgagtatgacaccgaaacttttgagcggacgacacaggaagagattgataaacagtatggaggaagcgtgattcaggaggaaacggataccatactggaaggcgaaatgaagttctttgtatgggtatcaagaaagcgctggggatttgtggtgcttccggtattgcgggaaaatgaagtgctttataaggggaaggaaaccttctttgattttgaagatgatacatgggaagagaatttttttgacggtagaaagtaaggacttacttcatatgacaggaggattattaatggaagaacaccagatattagatgattggagtgctgaaatattcgtgggaaataattacgaatattacaaaaacaaatggcgtgacaaaccggaacgtcaaaactttgcaagttggaactggcctgctttcctttttccgctttactggctggcatacagaaaaatgtatttagaggcttttttatatggggtaatctctcttttatctgtgatcattccggggagcggactgattcttcgtattgttgtgggaatatatgcaaattcttattattgcaaaaaaggactgaaaatcataatacaaacctccggaatgacggatggggaggctgggatgtacataagcaagcatggcggtacaagcgttttaagcattttcattaccatactgattactgtctttctagctattgcggtgatagcgggaattgtattttttcccacaggagagaagggaatttattcacagaatgcgcagtctgaatcttttacatcaaacgatttagtatttagttttcctaatgattggaaattataggaagaggaaaatccttttgatttgcagtgataatacaaaattgccttccaagtagttttgagaaaaataaatcaacgttagatgaaatagtaagttcgtgcacaccgaatcaataaataagcaattctcaaaataaggaggtgaaggaaagatggatcagatagaagaaatgaaatcaatgatcagggatgagatccagtcaatcagcaatctggaggagcgaattgtatttaaaaacttaatggaaggcgtgtttttagaactgtatgaaacaaacgtaaagatgtaccggatgttagaggagcgggtgatgaatgatcttgcgtatgacatcaaccgttatttaatccgtacgggtctaatggaacgtacctatctggataagtcccatcatctaatgtcccccatatgtgaagaagatttagaaacggcctcctataagatttcagatgtgagggagaagcttaaggctgaggaaaaattttgtctgtctaccgtatttttggaatgtgatgctttgaaggttgaagagatattaaaaaaccaggaggactttacaggaattttgcgggcaggaaaagagtatccggttaatatccgcttagtacggagtgaacgctatgggaaggaaatagagcatctctatcacctgttcatgaaaaatggaatcccatggaaaaccatcaatgctccctatctttttaaaatggctgacatttgtattaccggcctcccggatgaggtgagggatgaggagtcagtgacaaatttcggaaccgatttcgggaagtataaccggtttgtccattacgatatgatccccatatggaatgtacgtcatttgaagctggaaagcgtaggctttcccattgcctgcagtgatcatgaaaattttgagcatgtgatatccattcaggatcatggaacagagcacgcatatctagtagaagaaaaggccggtattagaagcgtcaggcagagcggagataagcttttagtcaccgggcaggttgaaaatgcaaaaaagtgggacatttatatgatacgaagtggcgtagatcataaaatagaccgctatacttatccgcttatggagaacttaagaaaagacgggtttgcagagcgttttcagaggaaaatgggacagtcggtaaaaacaaaaggagaactggaacggtttatccgcggatttggcctggaggattttattgaataccaagattgtgccttgaaggaaaatggactggaattcttagaaacctactccatgaacttttttatagaagatgaaatccgggacagggaaggtaaaaagcagctgatcctctattttaagccaaaaggaaaggaaacatggcttttgcgggatttagcaagctttatctcctctgaggttcaggaatattttcccgagtacgaatgcggaggaaagcttgtatgaattatttgtgggaagtcatgttggcgttaaaaaagagaggagtaccgaaaaagagcattcggtttgaaatgccccgtgaattcagtgcttatatggaactgtctggttcttatctgaatcaaaaggagatagaggagggagagattattgaaattaatccctactatcggttttacaacatttttaaggatttcttccggccggatcaaaaggaatttcccaagcttaaagaaaacctgtttcatttgatctttcatcagttgatgcaaaatgatgcagtttccggaatgtcaagggaagagtattataagaagctgctttaccaggatctggcagaccatgcttttggaactcaggccaaagagaccatggctctctttggcagggaagagcaggaaattctgttaagcggcttgctaaagcagtatgaaaccggaagttctctggatatgtttaaggacatgatggaggcactgattccaggtaacattgtatatcgcagcaaccaaaactcctatgagatcctgatttatatcggacaaaaaaaggagaacaaaattgtaaagaaaatggattttttaatcaatatgtttttggagatgccttatcatgtggatatttattatgaataccattttggtatcatcgaaatagcagaaaccatggaaatagacgaaattatcttatgctgatggaggaaatgaaatgtttcagtatgattatccccaatttgaaaaaaagcgccttttaagggccgagatgctggataagcttagggactatcctaaggtttttctggatctgcagtttcagggatttggtgatggaattataaatggatgtgacattgtctggaatgacggacaactgaccatttcccctggcatgatttattggaagggaaagctttattttatggagcagccctatatggtggagtgcagtgcccaggataagatacggtatttaaaggtgcagtttctgaccgaaatcagggtggcaggaaagatcatgggaaataccaggatctttctggaggataagaagccggatacgacctgtgaaatggagctgtgcaggttccggcttcaggaaggagcaaagctccgcagctgttatgagaattttcaggattattccacggagtatgacacagtgaacttaattcatcagccctacgcggcagaagggggaagtacattaaatcccaggatcatcaggcagttttcaaaggagatcataagaagcagaccgttagatcctcttgatgcaagcttttccgtgacggccctggccgttcatggagttgtgacagttgactgcatccgggaatatctgtttgctagattgggagaggattatggagacaggggacatggagggctctatagaggacttatggtgattttgaataatcagaggaatggggaagtgagaagaggtgaagttagccggggaaagagaagtgttatgttgttataaacgggagggaaacgaatgaatctgggtgaaaagattgcactgttggagcgtgccagaagacaaaaggtaagagaagaaaaggaacaggcagtaggaatggtgcttaaattaaaaataaattgaaggagggattgtatgattgatgagatgattttgggacttgtaaataaagatgctttagaagaggataatacgcagctaataaataggtgtttatttaatgggacaattttcatggatatgccggtggcgtttacagaactgtctgataaaaaaataaaagaacgttacacagtggatccaagacccaggattgtttattcagacgaaagcggcaaaattaattttacttttaatatgttgaatgaaaagatacctgatttgcagttatacgtatttaaaatcagagaatcgataaaaatggtatatccaaatactctattttacgaagaaaacttttttgcagatccagacaatgtttcaattcaatactttgattttagaagttcatctttagaaggatcaatctataacgttatgtacttagtacaattgactgacaaaactttgctaggggcttttaactgcccttttgaagtgtacataaactggaaaccggtagtaaaaagagtaattaaatcaataagaatttaactggatttttatgaaagaggaggagttttatgaaagcattgcaagttagaaccgaaccatttgattttttagaaattcatgagcttactactaaacgttatgtaaactgccattcgattttgaaaattcagggaattattgatggagggtcagaacaggaatacgtaaatcattgcattagaaacaaataccctcagtttcaaatgatcattacagacgaagaaacagagcaggtgttttttaatggatttattactcagtttagtatgaaaaatgaaggaaaattatgtgtactgactattgaggtcacaagtgacacctatagaatggacttaaatgaacatttacgcttttatcaggacaggaaccagccctataaagagatcattgacggtatttgtaatacctattcaaattgtaattttatgattaagaacaaagacgtacagtcattgaacgattttacaattcagtaccttgaaacagactggcagtttttaaaacggttagcaagccggtatcattcggtactcataccggaagatcgtacaccaggtattcatttttatctgggtattccaaaactaaatgcttatgaggtaaaaaaggataattacacactgacaaatgaaattcaggattaccacaaaaagaatagtgaattgaaaatgaatcagtatgatctgatttcttataatcttactgatagaaaggtctattacctgggagacaaaattttatttaatggatttgaactgtatgtgtatggggtaaatagtaagctttcgtatggtgaattgattcatcattatatattaaaaacaaaaaatgcttttcaaacatcatatataacaaatttttctttgataggagcttcttttgatgcggttattactgacatagtgaaagataaggttttgatagaactcagacagggagaaaacagctcccagtcaccggccatggaattcccgttttccaccgtatattcatcagcggatggtacgggatggtattgtatgcctgagaaaggcgattcagcccggctgtatctgccttccccaaatgaatctgatgcatatgtaaccagtgctatacatcaaaagtcaaccgatccaaatgccagaacgaatcctgatgtcaaatcattaaaaacccgatatggaaaggagatttattttactccggaccgtattgttatgactaaccacaaaggagaaaatattacgatacatgataatagtggaatttcaattgagagcagtaaaaacattaccatgagggccaaaggagatatatctttaacaagtgtggaacagacgttgaccatgaatgcggctgatcaggtcgacattggtcagggaggaagccggcttgtcatagacgatgatattgcttttaaaggcggtaaactgcggatggagtaaaatatggaccgattgcaaaaaatacaatcagaaggcagtaaattaatggagccggtattacataatcgtttgaaagaaatacagacttatttttcggataacagagatatgatcataacggatttcaaaaaatccgtagaaatgttatattcagaagcccacagcttgcagcaaatgaataaaaaagatcccgttcagttttttagcatcagctatctgcaaagatgtatttttacaaagaaatatgaggtacggctggatctgtataataaagatttttatttagaaaggtgcaggactgttcaatattggaatatgaattttatatttcagttttttgaaaaagatatggaatattttaaaaaacatattggtgcagtgatatttcatttaaaagaatacgaagagaaggaatttgctttgtggtatatcactcattattacaaaatagcagaattgttttttagggatcatatcaccgatattatacacaataaattttcagaagctttagaaaagaatgaagattttaaagttgttttcggcggatatatggatgagcaagctgtattatttgaagaagggaatgacagaatatgaaatattttatcctttcagagcaggaggagaataatcctaatccagatattaagaattggtttggaaaaataacctcaaaggataactcagagcaatttgatgcggaaaaaagctggattctacttgactcgaagttgaaagctgattccatttatatggatatattgacatttccatgtatatttgtgtcagaaaaggtgatgaaagtaatctggatgtacaggaggggaataaaagcgataaaaattattttaatagatcctgacagtcaaaattctttgttttattatttgccggaattaccggagcataggctgttaagtatggaaagtacctttgataaaactaagagcagattattaaaaggatcattagataagaataaaattcaggatattccattttttatcctgggagaagtcagtaaagcaacattagtaatacgtgaagacgttgcagaaagtctgatccgcagaaatgtgagggggataaagttacaggaattattaattgtgtgagggaaagcttatgattacaaaaaataatcttattataactggccttggttcagttgtgggtgtaaatgatttgcactttagtatgaatccaaatcagcatgtgaaattaacggttgatttgcaactaaaaactgaactattatgtgattcgttatatagccagtctatttctattggttacaagaaaaatgggcaggaatatttcattttttacgggtttgtggaccattataaccaaaaaagagaagggaatttatataccgccagattatctcttatatctgcaagtattaaactggatgaaaaaaaatacatacggacatttcaaaatacagagcagacctataaaagtgtaatacggagtattctataccaggttccaaaagcagatgtacttttttcggtgaaaggcaaggaagaatctccgatccaggacctgctggttcaatatcaggaaagtgactgggaattttataaaagaatagccagtcattttggcagtgtgctgattccggatattaaaaccggagaacctaaattctatttaggttttccagagggaaacaagctcatagatgaaaaattcacatcatataccgtatcactagacgagcggtattttgaaaacagagcagaaaatatgcaaaaagattggtttgtattttatagagcagagtcagaccggttttatcagattggagacgaggttgaaattgatgggagaagacttcgggtgctgagcattttggcaaacatgatcagaggagaaattattttttcctatgaatttggaaggacagatctttattataagaaaaaagaatataatcagcaattaatcggcgcatctttgacagggacagtgattacttcggtgggaggagaggttaaactagtatttgatataaatccggaagaacaaaatataataaaaacctatccttgggtgccggtaacggggaatatatttacctgtatgccagaaaagggagagagggctgctattatatttactaattacaatgaggcagatagcatagcgatacagtatttaagaagcaatgatatttcaaaatgtcccaacgtatcctctcctttcgaccgatattttacaaccagccagaggaaagaaatgaaattagttccgggaactatgggctttgataatcatatgggcaattccctgacattggaggatgagcagggcatcgttctggaaggtgatgaaattttattagaagcaaaaggaaaaatcttattaactgctgatgggataaagacctttgcgccattacagtccacacttattaaaggtagttccggaggaggaagcattaatatctgtcaggattttaatctatccggtccggttaaaatccttgcacaggcaaatccattaactgaggaggaaccggttagagtttacagcaataaggatactgaaaaaataggaaagcaggcattaggaatgattcctgccggaaaaacagaggataaaataatcagtcaggcattgggaatgattgtacagagataagggggaaactaatattgggaaagaatgcagatacaattaaaatgggaggaaaccggcaagactgcggaccgtccgtattaaaaaaggtcagcaaaaacgaaccggaatttgatccgggcgtatttataaaaacgaaaccaaataattctacattcatcaatggatttgaagcatccttaaaaagtatgaattttaagtaaaggggtgagtaaaatgagtagttcctatttagttaaaggtgcaaaaattaaatgtacatgtggttcccaagtgggtgaactgattgtagaaaataagaatgtctgtctgcttaaagtaccgatcgcaactgtggatgattgtaaaacgggtgaaaatatcccaagctttggaatttgttctcacacggggaaaccctgtgttccaatgattcttggaaaatggctttgtccccatgaacagactaagatcaatggtaccagtgcaataacaacggattcggcacttgtttgtggtaagggcggaatcattctttcagagacaagtggtcaggaaacgatcatgaagcttttaaaggaagcgggaaagatttttaaaaatctttttggtttgagttgtgctccttttagcggagatccagtcaaccttattacaggaaattacgtgctgcagtctgaagatcttcatattatgggaagttatcctctctcctttacacgaacttataattctctttcagatgaaaataccgtgtgcgggaacggctggaatcataatcatcaggtttacctgatcgatcatcgtgaaaccatagagatacatactggggttggaggccaggtccgaacgtttgaaagggcggaagcaggggattataaaacaaatgaattagcgaaggaatccttacgtctttcaatggatgggtatttctataaggatattttaaaccagacttttgtttttgataaagatggcttatgcaaagagataaaagataaaaatgggaattcaactatttatacatatacgaaccgcgttctttcgaaggttcagaacttatcaggttattttacattctcttataataacgagggaaaactggccggtgtgagtgatcattccggacggtctgttacgtttgcatatgacaatggcaatttaatcaaagcagataatctttcgggcggttttaaagagtatacttatgataaaaaaaaccggttaatcgaggaaataacaccatatggtgtgaaaaaggtagtcaatgagtttgataaaaatggacgggcagtcaaacagttatttcccgatggcggagtcatggagtatgaatatgatgatgacaggactgtatttattgaccagaataaaaacaaaatcagattttatagagataaatggcaacgggattgcaggattacttctcatgaaggacagatagaaaagaaatataatgaaaaacatcaattagccgaaattacggattacaatggaaataaaacctgttacgaatatgatcatgatggaaatatgactttaatcagggaccctaccggccatgagacaagaattgagtatgacagaatgaagcatcctgtcagattaatttatccggatggctctgttacaaggactgattataatcaaaatggacagatactccggaataccgatcaattaggacggacgtttcagtatcagtatcattccaaaggcatggtagaaacggtcactcatccggatggctccgaaatgcatgtccaatttgatggcagagggaatattattgaagtagcaaacccttttcattcaaaggtgaaatatgaatatgaccagttaaaccgcgttgttgcaacaatagatggaaatggaaataaaacacagtatgtatataatcaaaacaacgatattgttgagatgacagacacgttgggattcagtaaaaaatatttctataataataatggaaaaattactgagatcatagatcagaacggtaattcaacaacctgggaatacaatgatatgaattgccctgtcaaaaagacagatccacagggacgtgaaaccttccgggaatatgatcttatgtggaatgtcagccagcagacagaggcgaatggcgcagtcacgaagtatttgtataataaatccaaccgcctggagaaggtgatagctccggaaggaggagagacatcctatcagtatgatggaaacggaaaccggataaaaacaaccttaccggatggctcaagtgtactgtataattacgatgccctcaaccgaataattcaaattaattatccaaatgaaacatcttctcgttttgaatataatttttcgggtaaaataaccagagcggttgatccgatgggcggggaataccacatggaatacgatgctgccgggcaaaaaataaagcagacagatccatctgggaaaatcagtagttttgaatataatgaattaggattgatcacaaaggtaacagaacctttgaatcgaattactgagtatcaatactttccgggtggcagactgaaaaataaaaaatttcctgatggcagtgaattgcattattcttatgattccaatggtaatcttatagcaaagcaggatcataccggttatcaggtagaattcacctatgacgccctaaacaggatttctttcatttcaaacagccgaggacaaagcaaatcttttacttatgatggagtcggaaacctcctgtctgtcaaaaataataaaggagttgtgactgattatgaatatacaaaaagcggatcactgcaggcagtcattgaccctgccggactaaaaactctttacaactatgacgaagtagaccgaattgtttctgtaaaacagatcgcaccgctgaccttagaggaagaactagaagaggctaggaatataaataagcaaaaggaacttttactggtacgttataaacggaatttagaaggtgaggtaatatgttctgaaaatgctgcaggtcatgaggaaagataccaaagagattattttgggagaattcttacccatacggatcaggaaggcatggaaacacattatacctatgatccatcaggcaatataagcaaaattgtatatccggatggaaaaaaagttatgatggaatacaatgcattaaaccagctgatccaactgaaagactggcttggcagcacaacaatccagcgtaacagttttggaatacctgatcagataaccgatcatcagggaaatacagttcagtatgagtggaatgtttttgggaacagaacaagaacggtttatccggatggagaagatattgaatatgaatatgatgatgccagtcaaaagattaagaaagtccattgggctgatcagtttattgaatatcactataacgaagcaggctttttatcttccagaaaatgcagtaatcaacaggaatctcgttatggatatgactcgtttggccagctaaagtatttaagccattcttatcaaggcggatttttaaactatcaatatgaatatgattccgatggattacctgttaatataaaccggatttcagagaaggggaaggagagcttccggtatttttatgatgatttaaaccgcttggccgaagttagagatggattgcatacagtaagaaagtatgaatatgatccgtacggaaaccgtatttttaagaaagaaaatggaattgatacacagtatcattataacgaattgaatcagttggtcagggaagaaacagtagactttatcaggcgctatgaatatgataaaagagggaacattcgctgttgctatgaaaatgaggaaatgcaggatgcctacttttataatgggagaaatctattagaaaaaatcaggaaaaaaaatggcacagaaatatcctacctttatgacggtttcggccagcgtacaatgaaacagcaaaaagagcatgcggaatcagatttttatggttatcaaaagccagatgaatccagtgtagaatttatcattgattatgccaggagcaatcataacctgattggagagaaatgtgatggcatccccaaaagctatatatgggaaccgcaaagtcatcatttgacgggattgattgaagatgataaaagcttcttttatcaaaatgattctttaggaactccaatgcggttattaagccaagcaggtgctgtgaggacaagttatgattatgatgagtttggtaaaccgaatcgaaaagtctctggcgaatcatattttggatttaccgggtactattacgaagatgaaacagaactttactatgcggggagaagatactataattctaatatgggattcttttatggaagggattctgtgaaggggaatacctgtgaacctatgacccttcatccttatctatattgtttaaataatccattattattcattgatcctgatggtgcaaaacctggtgctgtcacaggtccagatggaacggaggcacacactttattggaggcatattttaaggcctattatgctggattgccatatgtagctcgtactgaagaaacaatacctggtggaaatcctgaagcaaaaacaaccaatggcagatacgatatgattttaatgtatcaaaaccaggtagaattgtatgaaatcaaacatataagtcatcataatcaagcgtcacatatgagtgatttgttacggtttaatagttatatggctggtctacggaaaatgtatccggggtataatatttctccgggtacgacatttaaccctgaccagttgtatataccaagtgaacgctatccggattattatataagatactatacttattataatggtggttattcaatgcccataaatgggaaagagtttaatcaaacttatgcaggattcatatattggggttacgtaaaaaaggatgaagaaaaagataagcatagatacatatggattccaaaccaaaatagtaattctaactctggcagtaatgataagaaagatgataacgtgatacaatttcctgatgtcaaaggtgaagacgtagctgcagctgcaattgttggagctgtattatatggggcatggtggttgataaaggctggagttacatttagtaccggttttcctgcgttggcgtgcccattttaaaggagactatttatgaaaaaaagagaaattataaataagattattggagaagtattggaaccggagggacttatttttagtgaaaaaatagatagttgttggtttattaaggaatttaaaaatagtaagggagaaatagcaaggcaggttatagaattttacagtagtaggtgggaaaaaaactatttatggatattaactgtttttcaggaagatacagtagttatcgaatagacaattttgtgccgggttgcagggacgatggccttaaatattccacaacaggagaatataagcaggcagttgaaacttatgcagatatactgaaaaaatatggtttagattttttaaagaaaattgctgagccaccgaaagagaatgattattttagacaagaagatcattataagctatttaatgagcatgagagtacggctcaaaaatttataaaagagcagcagatagacatggaatgtgtcaagatagaagatgcagtaaggctgataaaagatatggtattagagaaacagggagaaccatttgatgattgtcgggagttgtttttagaaatggcagcattttatggacgtgttgtaagtaaatacaattcctgtaagtggttgatgagggatatgaaaactcactttatttgcaaacttgaaattgaatctaaacggaaactatctttatctatgcttaatgaaatccatttggcatggaaaaacggagtggacagactgaattctttaataatctaatatttattgtgaattaaaaactcttgttaatttaattgatctgaaagagtgaggtgatgcattattctaatatcagatgagaagacgtagctgcagctgcaattgttggagctgtattatatggggcatggtggttgataaaggctggagttacatttagtaccggttttcctgcgttggcgtgcccattttaaaggagactatttatgaaaaaaagagaaattataaataagattattggagaagtattggaaccggagggatttatttttagtgaaaaaatagatagttgttggtttattaaggaatttaaaaatagtaagggagaaatagcaaggcaggttatagaattttacagtagtaggtgggaaaaaaaactatttatggatattaactgtttttcaggaagatacagtagttatcgaatagacaattttgtgccgggttgcagggacgatggccttaaatattccacaacaggagaatataagcaggtagttgaaacttatgcagatatactgaaaaaatatggtttagattttttaaagaaaattgctgagccaccggaagagaatgattattttagggaggaagattattataagctgtttgaggaacatgaatcacttgctcaaaggtttataacagaacagcatatagagatggaacatattacaatagaagacgttgtaaaattaataaaagatatggtattaaggcaacaagtggagacatttgatgattgccgggaactgtttttagaaatggcagcgttttatggttgtgtggtaagaaaaaactatccatataagtggataatgaatgatgtaagaacccacaaagtttgtacactagaaattgattctaaacaagccccatcatggcttgttattactggaaaaatatcattatttgtcactaatgacattcatttggcatggaaaaatggtgtagacaaactggataccttgataatttgatagctgcgatagtagttattacttaatgatccttgagtttgcattgatgataatatgtcttctggtacacattcgatttggatgaattagatgttgtatcagaagatataaaaaagtgaaagcagcaatgcagataaacataaaagaaagaacaataactaaaccggagacggaggtgcggacgtaaccttggattatcagtgtaagttcaactttacgtccgcacctccttccctcagttaatgcttttgcaacagccccttgaaatttgggctgtacccatgtatatgaaaaaatttaaaagaagaaatcccaggatgcttctttcatctgatcagcgattatttacataataatgcctgattaaaataacactgatcacatctgccagagcccacccaataggaattgcccaccatatcccaacaattccgatccagtttacagcggatagcatataagccaggataactctggtaccaagtcttacaatggtaagtataatggataccaccggctttccgatcccgcggaacttgcaacaaatattgtattttctatcgatccagtcgatatggcaaccggtgcattctgtctggaaacaactgacctgacgttagcaaatatgacaaaaagccagtttcggatccaacggttttataattcccgtctgtcatgtaagggaattatggggaagggctggaggttaaatttagaatcacggttatttctccatgacgaggaacaggcaattgatgtgctatgctttgacggacatatggagcagttttttcttcaggaggagaactaccgaaacatgcggcagggagatgagcggtatcaattgagaaagctgccggaagaaggctttgtgatgatcgatatcccaggtgaccagaagtattattatgaccaaatgggccgtttgactgccatcaaaggacgaggccagtgcagtacggagatccattaccagaaagctcatatgagccaggttgtgacagcatctggatatgtgattgattttatctatgaggaagaccgtcttgttgaagtcagagaagaatcaggacgtaccatacaatacaaatacgaaaatgattatttaacagcagtatgtcatgtggatgagggaataactacctatcagtatgaagaaaatcaccatatttctcaagtgatagatcaaaacggtcatgcttatgtaagaaatgaatacgatgaaaaaggccgtgtggctgcccagtattatctggatggcagtaaaagcacaatccggtatgatcctaaaaaacgggaaaatattgtttttattgaggcgttgggaagaaccgaacggtatcggtataatgagcagtgtttaattactcacagcttctttgatgatgggacaatagaagagacaggttacgatgaatggacgaataagatctatgagaaggaccggaatggaaatatcatcaggagagactttagtgtttttggcaatatagtaagggaggagctgccttccggtcagatctgggagaatgaatatgatacagaacagcatttgattgccaggacagcaaataccggtgaagagttcagatatcgctataatcctgatggttttttagtggaagaaaggacgaaagtaagagaaggtatttggaagcgatcccaatatgaacgtgatagctatggcaggattttaaagaaaacagacagcagaggaaacgagataagctatacctatgataaaaatggcgggcatcttttaccggaaccctctcaggttacggatgcggttggtcaaacaacgatctttgaatacgatcaggcaggacgaaaagtttctacaactacggagtatgggacagtagagttttgttataataagcaaaactatatgatctatgtccgtgatggaaaggaaaatgaaaccaggagagcctatgataaaatgggaaatatgacggctcttttcccgcctaatcagggagtcggcggccatgcatggatgtatcagtatgatttctttgacaggttgactgaaacccgtgatccattgggaaatgtctggaaacaggaaagggatctggctggaaacatcatcagaaagatacacccctgcggttatgcgaaagacggagaggctggctatggtactcgttatgaatatgattctgacagcagaaggattcgcacgatctatccggatgaatccgtggagcgatgcttttatgatggaaacggaaatttgatcaaaaaggtaaggccggaatcttatgatgcacagattgatgatgggaaagggatttgttaccaatatgatggcatgaatcgtctgattcggatcatcgatgaggagggtgtggctcaaaaaaccttaacgtatgatttggcaggaaatctgactgaagaaacggatgccatgggttatacaaccagccatcattatgatttgttagggaatcggattgcaacctggaaaccaatcgaatcaactgaagaagaagtatggtattcggtaaacttgtttgagtatgatacagaatcaaatttgattcgtgaaaagcggggacgcgataaagttcattatggagactatcccctccgttatcatgaattatattttacctatgacaagttaaaccggttaaccggagtgaaagaccggcatggagccaaaactgtttatcaatacaactgcttaaaccagaaggtttatgaaagctttcagatcagtgaagcagtcaaacgaatgatttcttatgagtatgattctgcgggcaatctggtgaaaaagaaagaaggaatcgaagaaaggttcttaaaagcaaaagggaaagaaaaaaccatcctggcagttactcaatatgaatatgatcccaatggaaactgtgtccggatgataactcccaaagggtatcggaaggattggtactatgatgctctggatcgtgtgatcagggaagaagaacaggataaacagggaggaatccacagaatttatgggtataagtatgatccggcaggaaatctgtcagaacgagtggatcaaagcttaaaggaccgcgtttacagccgccggtaccagtatgatcaaaaagacaggctcacgcatttcgtggatgaaaatggaggagtaagccgttttatttatgataagaatgatcgtattttgaaggtggtacgtccggaacaatatcaggccgattgtgataacggagcaggaacagagtttgcttataacggtcaggatcaggtggtatcggtaacaacaccagacaaacgcatactgcatcaataccagtatgatctgagtggaaatctgcattcggtatggacgggtgagactgaatataccgagtacacatataatgcagaaggtaaaacggtaggggtctataccggtaagggccaggccgagaaaagagaggcggcgcagtcctttcagtatgatgcccagggaaatattacaggagtcagggatgggaatgagaacctgacccagtttgtccttgatgactgggggaggattacagaggtatatacacccgatggaggaatcgaacgttatgcctatgattatgccggtaatatcatcagtactactgatgccaacggaggaacgattacttataagtataatagctttggccaggtgtatgaacgggttgatcaggaaggaaacagtgaatatttttattatgatgaagaaggccgtccagacctctgcatagaccggaatgacaatcatattactacccactacaatatggacaatcatctggtataccgccgggccgaggatgggaaaggaagatatgccgttaccaatcagtatcactattatccaaacggcaggttaaaagagtcggcaggggatggaattacctatcaatacgattacacagccacggggctgttaagcaggaagtcatcagccgggagatcgttactgtcgtatgattatgacaagaatggaaatgtaatagaactgacagatgtaacagggattgcaacccggtatacctacgatgttcttaaccgggtcagagaggtgagagacagtcaaaaccatacatttctggcagcgtatcaatatacgccggaagggaggatccgttcccttgcctacgggaatggagtcaaaacagagtatcaataccaggacgatgggctgatggagcatctggtgacagtaggctctgacgggaaagtactgcttaattatgcatatgcctatgacggaaatggaaactgcacgaaaaagtcaggggatgtttatcagaatgcatatggttatgatgtaatgaaccgtttgtcagaagcaacgtatcacggtgacacagaacagtttacttatgatctggcagggaaccggttaaccaggaagacccaaaccggagaagaacgatatgagtataactgtaaaaatcaactgacagggctggaaacagaatcagaccacatggtttatctctatgacaagcaggggaatctgttgtcagaacagggaaaggatgtcagccgaacctatggttatgatcctttgaaccggcagaacagcgtgaccacggaaaaaggtgctgccagctatcggtacgatggagaaggcctgcgttatgaaacggaagaagcaggaaaggtgatccgttttgtatttgaccggggagaattagcaacagaagagagtggttcggaacagaaacgttattgccggggacatcatgtgatgtcattgcaaagtgcaagagaggactccccgcactattttgtgtgtgatgagatgggaagtacgatatttctgctggatcaggaacaggagatcagaaaaagctaccactatgacccgtttggaagtataatagaaacgtcaggaagtatagaaaaccgaattacctatacgggtcagatgtatgatggaatcagcggtcaatactacttgagggcgaggttttataatccgaagatcggcagatttatgcaggaggatgcgtaccggggagatggactgaacctctatgcttattgtcagaataatcctattacttactatgatcccagtggttatctggggctgtgtccggcggggaagagtaatccgcaggcggagcagactgagggttcgggtaagattgcacaacaagaaattgatgcattgaaaaaaactgtaattgatgagggacagatactcaaggatatgggattaaataataaagaattaggtccagcaattgcaggcgcctatgatagcaaaacaggaaaaacctatacagcgattaatgagatgcatggtgcacttccagatgagttacacccaattttaaaagagcgaattatgaacatgccaccagaagttctagattcatatatgtatactcatggagccggttcacatgcagagatttacgctgctaacaaagcattattagcaaatccagatgcaaatatttctgatattacaatttatgtaaacagaacattaggaacaacgaaaccagtgatagaaatcccgtttcaaacttgtccacattgtgagtatattttacgcggctttaatataatatcagatataaaataagaatgaggtaaatgaatggaacaagaaaaagttttaacaaaagaagaagttatggagataggtctttgttttgatggagatatagttttctatggtggtgagtacggtcaacaagtgtgcagaatttctgaggaaggagtagaagaacctgtcacaggagttatatttgaattatataagagccaaaaattgaattactattgttattataattgtggtatttcaaatggtcaatatgtttgcttctatgagaatggtaatataaaaaacattagttatatgcataaaggcacgaggcatggaaagtctttacagtactatgaagatggcaaaaaaaaatctgagagtagttataagtatggattttgtgagtcatttattgaatgggatgataaggggatattagttaaagagcaaacagagccaactgaatttgataaaaagatgattgaaaaatacgaaaattatgaagaacaaaaaagaaaagagtaatggcttagaggcgtattatactgagattcaactcgattttgctgataaaattgaattgtttgataaaattaaactagaagatataaaaacaatttcaggaattgatttagcatattggagagaaaaaggtacagattatgcagtttgttgcattgtaacaattaactactgttctaaggaaatagtagaaattaaatcattaactggcaaaattgatgttccttatattcctggttatttatcctttagggaattgccgttgataattaatacttttaaaatgttagaatcaaatacggatttaattatgtttgatggaaacggatatttacattatcggaatatgggaatagcgactcatgcctccttttatcttaataagcctactataggtgtagcaaaaagttatttaaaaatcaataatgttgattatttaatgccagaagattttgatggtgcctatacagatattattataaaagacaaggtacatggtcgtgtgctaagaacacataaaggtgttaaaccaatttttgtatcatgtggaaattggataacacttgatacatcaacaaatattgtattgaatcttatagataaagatagccggcaacctctaccaacccgtttagcagatattgaaacaagaaagcaaagaaaaattataacgggaatttaatttatgttatatgaacatagtagtttcatttaagttatacttttattattaattctcaggcacagtgacttttatttgttgaagtcgctgtgctttgttgtacaaagtttttaaatgatttaagcgttctggttctggataagcagttcaagggaacacattagagacattgatattattcaagactctaatacgtctcaacgataagtattagattgcaaagcaatttgaaaaagttgcagcaaagtcgattaacgctttatccgaatcaagatgcatcagttgatttgtggcaacgaaatttaaatagaattaagtaaaggagtatatgttatatatggataaggaaaaagaaaaaattattcagcaaatgttatatgaaaaaaatgctgaggaagtattaaatgaattacacggtattaatgatcctgaaatactgtatgtgtatgcctacaattataattggaataatgggtttgagatacctaaaaatatacttcttaaagaatgctgtaatctaagtatagcattaatgattttttattcggctgatggatttaggtatttgcagaataaagatgaaaagaatgatagcttaaaggaatggtctatttttattaaagatttgtatcacatgatacttgaaaatagatttataaaaaatgacacaaaatttgttcctcctttaagcagtgttcaaatatttaaattgaaaaaagattttgttaatgaagaatatgtctttttagaaagcataggaaataatgatttgaacataactttataaatacatttattagccataatgctttataattattaagattaattcattaaagcactatagcttttgtatgttttcaatttatgaaaacttttagggctgatttaatgcaaatcgtaatgatgggtttggtttattaatagaaaatcacaatttatcaatatattttaacagtttcataccatccataaaaccatgttgatatagaaaagcttcttccaacatgaactgccttattagcgaatcaatgtgattttgaactagttctttttccttgcttggtaaattatcaatgaagatttcggcgtgaagaatttgcttatattcttcctcgtattggttcggctgtttttgatggaatatttcaattagcatagcgatacgttcctgaataaacatatccagtaattcctgttcggtcataatgtttccctcctttgagaacatacgataccgaaatttctttagaaagtcgataccataaattactaataataagcttttaaagcagcagaaatgaacgataggcataataggtggacgctcaaggtgtacttcgtaaagtcttagtgcatgccaatttttctagattccgaccacctttactgtgacaaagcgtaaatccgaccacctcatgtaaaagtccctcaaacgcccagcactgctgggcgaagtggatgtcgggtggttgcttttgaccacccggctttctcctgctctattttcgacccggtaaatacaggctaaaaaatctgcctggatataggctttgcggctgattcgtaattcggcagttcagtggactttggtagaaagatatcaataaggcagttgggatttctcgtttgccaaatcgccttacgtttggttttaatcagtaaatggtcaactatgcggcctgagtcttgttaagggcatacaggggcaacacgagcgtacaaacgggctaataaaaaaggattgccagcaggaacggtgaattgtgtgttaagccgatagtctttacaagctctgtccaaaagtgtcataaaaaagtaaggaaaaagtttaccaatacaggggtgaacccaccttctcaaaaaaatccacttatggtaaactggacaggaggggggctacggggggagaaatattcttgcggcagcccccttttcttttttctgttctttctcctaaaaaataaaatcagaaatgacttgtaatccattcgatagagagttaacatcaacaaccaatcaaagaaataacttgtcctttcacccattggtttgttgtagataggctgtcgaacccttgcgggctcattccgagttaacgctgtcatctgaggttgccggtacaggaactgactggttggaaacaagagcaggagggagagaattgcagagaagagaaaatctgctttatgtggggattgatctgcataaagaaactcatacagcagtaatggtaaactgttggaatgaaaagttagaggttgttgcgatagaaaacaagcccagtgaatttaaaaagctggcagaaaaggtaaatagaaaatcacgtaatcttgggctgaatccgatttacggattagagaatgcctatggctatggcagaagcttggcggtctggctgattgaaaatggttatgctgtgaaagacattaatcccgccctggcctatgaccagagaaaaagtgcgcctatgttccgaaaaaatgacgagtgggatgcatactgcgtggcaacagttttgattaatcagttgcatactttgcctgatgcaaagcccaaggataacgaatggactctgtcacaattggtaaaccagagggaaatgttagtaaaagacggaatccgctttaaaaacggccttcatgaacagatatctatggcataccccagctatcataaatttttcagtgaaatcgatggaaaatgtgctatgtacttctggaggacttatccttctccagtgcatttagaggggaaaacagcagaagaattaactgctgaatttaaagaaatagcccgtattacaaaaagggataaagcggaactcattctggactgtgttcggaatgatggaaataccatacgggaataccaggaatccagggattttatcacaaggagtctggtaagaaatttagaacatcagaaagaagaactggcaggagttgatgaagaaatcgaaaagatcctgctcacctttgattataaactgaccagtatgccgggaattggaataacggtagccagtaagctgattgcggaaatcggagatatccgaaggttttccaatgcagataaactggcgagatttgcaggagtggcgcctgtcaagttcagttctgccggaaaaggcaaggaacagagttccagacaggggaaccgtcaactgcatggtctgttttatttcctggcagtgactatggtttctgtacccaagaacggaatgcccaatcatccggtatttcacagttattatatgcggaaaatcagtgagggaaagacaaaatctcaggcattggtctgtatcatgcgccagttggtgaacattgtgtacggaatgatgaaaaataagacagaatacagggaaccactgccagaagaagaacagtaatttttttcttaaaaatagcgtcaagatgtgctatacttttttaatagaatactaattttcacccctttccgtacatctcagtactccacctgagggttcggggatggtcttacaggtagcaattgggaattcaattctcaaaaagatgtcgatcttagaagtaccggaaaaacatatcaagatggacttgatgaagcattcaggcgaacgggagttcccaaagaagagttcgaagtgactaagtggggcactaatgagtacgggaaaagtatacctgtagaatggcaagggcctaatggggcgaatgtaaatatggacattccgcagtggaataatgttaaacctaatggacaacttggagaaggaccacatgcgcctcatatcggatatcaaactgctggtaagggaagcaatagaattaggggacatatatttgtagatagggttccagcaactagaaagtaggtgtgaatatgttggattatgtaaaagaattaattgaagcaagtaataagctaaatatagagatttgtctgctgaatgagaatgaggctcaagggtatattagggctgttttagcattttataatccctttaagacagatggacatttgggtatcggtaaaaatacagtttcaatacctacagaaaagtatgaatttacttattctcagtaccttaaagaagaaccagcatatgttttttggggccaggatagtaatattgcaagaaaatctgtagtaaaagtcaataatgctaaaagattaggagaattgttcgaaaattcatatggtatggagtactttgtatctaatgaaacaatggattacttaattgctgttaattggtatacaattgagattgcaggtcttgctacccaatatctattaccacttaatatatagagaaaaagaaataaattaagtttaaaatcagataaatttttataaggctataaattttaaagaaatattaacttatttaatttcaatcaaaaacacagccttaatttactggctgtgtttttgattgctataatgttcttaaagaattcaataccctgaccccagccataaaaccttgttggtagagaaatgtttcctcaaatgctaattgcccagtcatgtggtcaatgtatcgggacaatatctgcctgcctttggtaaaacatcgtttggtgtcattgcaaagtgcaagagaggactcccccactattttgtatgtgacgagatgggaagtacgatatttctgttggatcaggaacaggagatcagaaaaagctaccactatgacccgtttggaagtataatagaaacgtcaggaagtatagaaaaccgaattacctatacgggtcagatgtatgatggaattagcggtcaatactacttgagggcgaggttttataatccgaagatcggcagatttatgcaggaggatgcgtaccggggagatggactgaacctttatgcttattgtcagaataatcctattacttactatgatcccaatggttatatggggctgtgtccggcggggaagaataatccacaggaggagcagactaagggtccgggtagcaaggattctactacagcaacgcaaagaataaattcttcaggaatagtaacaggcggagaaaatgctccagatgcagggaagatgttatatggttcagaaggaaacgcaggtgttattccaaaagagattgctgatacactttcagggagaacatatgataattttgatgagtttagaaaggatttctggagagaagttggtaattcttcatatgctgatgaatttatgattaatggggatatgactaacatttaccgaatgagaaatggtggtgctccaattgttatagattctcagacaataaatggttcggtaacatatcaaatacaccacaaaactcccataaatcaaggcggcggggtatttgatctaaataatcttgttgttgtaacacctagatatcatgcggaaattttgataccagagtatcatggttataatggttttaacaaatattttaaataaaggagcaatttaataatggaaaaaataaccaaacaagaagtaacagaactcgtaagtaaaattagaataggagcaggtgatgataatgaaatttctgaatggatatcaaagatatcaatagcaacttctaatccagaagtaataaaaacaattatgtctggtaatgggataactgttgaagaaatagttgaaaagctatatagttacaaaccaattattttgtaagcaggaatcatatattttacttattctcagtaccttaaagaagaaccagcatatgtttttggggtcaggatagtaatattgcaagaaaatctgtagtaaaagtcaataatgctaaaagattaggagaattatttgaaaattcatatggtatggaatactttgtatttaatgaaacaatggattatttaattgctgttaattgtatacaattgagattgcaggtattgctacccgatatctattaccacttaatattagagaaaaagaaataaatcatgtttgaaattagataaatttttataaggctataatttctatagaagtattaacttatttaatttcaatcaaaaacacagccctaatttactggctgtgtttttgattgctataatgatcttaaagaataataccatttctgttagatcaggaacaggagattagaaaaagctaccattatgacccgcttggaagtatactagaaacgtcaggaagtatagaaaaccgaattacctatacgggtcagatgcatgatggaatcagcggtcaatactacttgagggcgaggttttataatccgaggatcggcagatttatgcaggaggatgcgtaccggggagatggactgaacctttatgcgtattgtcagaataatcctattacttactatgatcccagtggttatctggggctgtgtccggcggggaagagtaatacttttgaacaggaacaatataaaaatagaattaatcaaacacctagcgaggattcatcattaggtacttggacaggaaaaagaggtgaatcaacatttataccaagtgatcccaaattaagagagattatacaaacacagtatggagttgatggagttacttatacaaatggagttcctgattttagttcattttccgttggtacagttgagatttttaatatgcatgggggaccaaatggtaggaatacaaatttttccatggcatatgagcagctatctttacaaacaggaaaaagcgttactgagctaaaagaaatggttaaaacaaataaattaacatggcatgaatgtaataatatgattacaatgcaacttgtgccaacgagaataaattcatactttggtcatacaggtggggtggggaaattaatttttactttaagtattttggttattaagacttttaaacattagaaataatataaaagtactgtattaaaatatattgatacaatatctttagtttaattattaaatttttaagaggaggaataaaatggaattgataaaagaagtatttgagaatgaatttggacaaatggaaggaaaggtatattttgactacataaaaaaatatattacattattttttgataaagaagtacctatgccatatgtaataaaaactgtaaattatttaaataatattaatgaaaatgttgtagtagatttatgtagatattcaaaaaaattttgtgaaataaaaatgaaaaattatccggatgctgaatatccagatggtttaagtgaagttaaagatcctttagagatatttaactatatgcaaataaatcatttgaaagttgatatgtacatagatgaaagtgatcaaaacattcctgtactcaatttaggggggagttgtgattgggatgaggataatggtatacaatggttaataaaagaagataaggtggtttatgtaggtgtttgggatgatttagacatatggtattgtgattttgatgattatataacaaattatgtatgcagagaagatgagtaagtaataaaaaagtaagcgatgaataacctaccgtatttcagaatgacgtataattaaggacctgttgacataacgcatctttatgtaataagtgctgccctcatgcagtggcatcttaaataaattaaatagagaacagtttttccattctttttaggtttaaatttatgacagagagactgtttcaaagtctgtgtaaactcaaatactgatataagataaccatcagttaccatggggagagatcattttttggtctttcccctttgtttgtattataatgctgtcgtatgattatgacaagaatggaaatgtaacagaactgaaggatgtaacagggattgcaacccggtatacctacgatgttcttaaccgggtcagagaggttagagacagccaaaaccatacatttctggcagcgtatcaatatacgccggaagggaggatccgttcccttgcatatgggaatggagtcaaaacagagtatcaataccaggacgatgggctgatgaagcatctggtgacagtaggctctgacgggaaagtactgcttaattatgcatatgcctatgacggaaatggaaactgcacgaaaaagtcaggggatgtttatcaaaacgcatatggttatgatgtgatgaaccgtttgtcagaagcaacgtatcgctgtgacacagaacagtatacttatgatctggcagggaaccgattaaccaggaagacccaaaccggagaagaacgatatgagtataaccgtagaaatcaactgacagggctggaaacagaatcagaccacatggtttatctctatgacaagcaggggaatctgttgtcagaacagggaaaggatgtcagccgaacctatggttatgatcctttgaaccggcagaacagcgtgaccacggaaaaaggtgctgccagctatcggtacgatggagaaggcctgcgttatgaaacggaagaagcaggaaaggtgatccgttttgtatttgaccggggagaattagcaacagaagagagtggtttggaacagaaacgttattgccgcggacatcatgtggtgtcactgcaaaatgcaagagaggactccctccactattttgtgtgtgatgagatgggaagtacgatatatctgttggatcaggaacaggagatcagaaaaagctaccattatgacccgtttggaagtataatagaaacgtcaggaagtatagaaaaccgaattacctatacgggtcagatgtatgatggaatcagcggtcaatactacttgagggcgaggttttataatccgaagatcggcagatttatgcaggaggatgcgtaccggggagatggactgaacctttatgcttattgtcagaataatcctattacttactatgatcccagtggttatatggggctgtgtccggcggggaagaataatccgcaggcggagcagactgagggttcgggtaaggttccaaagcccggtgattcagactttatggggccattaactaaagccgataatcacttcattaatggagacggtattggaccgaaaaagaaaggcgtattaggtgcacataacttggataattttaacagtacattagagagtacaggatttccattagatgatctgaaagtgggtgaacccgttccgcatccgacaatagatggagtatatgctcaaaagtatcgtgtacctgcctacgatggacgaggaaattttcttggatttaaagatataccagatcctaaaacatattatgatcctaatatcatttctgacagtcaaatgttagaatggggctgggaagcgatgaaaaatggaactataaatggtagatatgttaaaggattttcttcaaatgggttagaatttcgaggtttttatgaggatgggaaaataacaaatttctttcctaaattgccaggagaataaaatagagtaggaggaatagataatgagagtttcagaagagaaagaaaagtatttaaaattatattttgaatatatatgctttttaggagaattagaaataggtgcagtgaaacaaatggcacaatcaaaaggacaaggggcagaatacatttcttgttccttcgatcctgaggatgaagactataaagaagggtacgtaaccttgttgttttggaaaccggcagatgatgaagatactatgatatttatcgaaaatagtttattttatgagcgacttttagaagtatgtaatgcgcatatcacaaaaaattccaatgacaaagaattattagatggttatttgaatcagataaaaaaagacttgaagatttcatagttttgaaaggttaaataggtattgcaaagaggatgtcccataagtcatttcatgacttatgggacatcctcatattcaacagaacatacttacttaagagaattcatttatagtttttcaatatatttagtatcttcataccatccatgaatccatgctgatacagaaaagcttcttctaaagcaagttggcttataagggagtcaatatacttatcaattagtttcttctcttcaactggtaaattttcaataaagatttcagcggttatatggggctgtgtccggcggggaagaataatccgcaggaagagcagactgagggtctgggggatttatctagaaaagaagttttgggggatattaagcaagaattggtaattcctaaatctcaacaaccagattcgcaaacaatggtaaggttacgtgatgagtatggaaatcctatagtagaaaatggtgacttcgtatactcaagagaattgacatattcagttacaggaaaaactgatgcacaaggaaattcgatccaacaggtagttatacaagatcattcgtatggacatttgtattcggatggagtagggaatcaatcatcgcattttaatgtcaggcccgatacgaatacaaatacaggacgtgtgtcaggtatgaaagaccactattactttaattatagaaataagaagtagaaagggaagtaatatgctgttaggttttgataatgagtttgttttaagtgagatttttggtgaggatgatgtctttacaggggctgcaatagataatattaactaccagccattaggttttaacatgaaaatggatgttttaacaaaatgtaatgtaaagaattcacctccaaaatggaaagcatgggatattgtatgtttaaatattgagttgtttggagtgaaggaatttcaagcaaaaatcaatcatgaattattacattcagaagtatttactattagtaaagatgaaactatgtatgttctggagattttaggaagtaacaagtctagagttttttgtaaatttggaggaggtcgtattcaaagaatagttccgatgaaatataatgatgagtttaaagggtatgaaaaagcataatctaagttaacgaatctgatatgcgataattcgagaaggaaagtctttctcaacggaaaggctttcccttttaaaacgcaactttaaattgatctaataatctacttactcgtatactgtcaataaagccatgttggtagagaaacgatatgatatgtggatgttcagggtgcatctgacaaagtcttggtgtatgccaactttgttacattctgaccagctttactgtgacaagctaagtttccgaccacctcatgtaaaagctcctcgcccagcactgctgggtgaagtagctgtcggggggtgttattgaccacccggctttctccagctctcttttcgacccggtaataatagattaaattatgataagaatggaaatgtaacagaactgacggatgtaacagggattgcaacccggtatacctacgatgttcttaatcgagtcagggaagtgagggacagccaaaaccatacatttctggcagcgtatcaatatacgccggaagggaggatccgttcccttgcctacgggaatggagtcaaaacagagtatcaataccaggacgatgggctgatggagcatctggtgacagtaggctctgacgggaaagtactgcttaattatgcatatgcctatgacggaaatggaaactgcacgaaaaagtcaggggatgtttatcagaatgcatatggttatgatgtaatgaaccgtttgtcagaagcaacgtatcacggtgacacagaacagtatacttatgatctggcagggaaccggttaaccagaaagacccaaaccggagaagaacgatatgagtataactgtaaaaatcagctgacagggctggaagcagaatcagaccacatggtttatctctatgacaagcaggggaatctgttgtcagaacagggaaaggatgtcagccgaacctatgcttatgatcctttgaaccggcaatacagcgtgaccacggaaaaaggtgttgccagctatcggtacgatggagaaggcctgcgttatgaaacggaagaagcaggaaaggtgatccgttttgtatttgaccggggagaattggcggcagaagagagtggctcggaacagaaacgttattgccggggacatcatgtggtgtcattgcaaagtgcaagagaggactccccgcactattttgtatgtgacgagatgggaagtacgatatttctgttgaatcaggaacaggagatcagaaaaagctaccactatgacccgtttggaagtataatagaaacgtcaggaagtatagaaaaccgaattacctatacgggtcagatgtatgatggaatcagtggtcaatactacttgagggcgaggttttataatccgaagatcggcagatttatgcaggaggatgcgtaccggggagatgggattaacctttatgcttattgtcagaataatcctattacttactatgatcccagtggttatatggggctgtgtccggcggggaagagtaatccgcaggcgggtacggaggataaacctgatcttcaatatcggctgaaagatcaagatatggattggagaggtaccgataaaacatatagagatgcagtagatgaagctttcgctcagatagaatcacgaaccggatatacaagagatcaattcaaagtgacaaaatgggctaaagatttaaatggaaaatcaattccagtggaatatttagggccagataaatcctttgtagatttagatcttgcacattatggagtagatagaaatgggaattgggcaggtggaccagatacaccgcatgtaggatggcagtatggaacgaaaggaaaaactgtaggacacattttagtagacgtgcctacaggaagagattatacatattccgatttgcttgaacaaatctataaacaagtgcgaccaacttggccaaagatatattagagattcctatataaaaaaacgagcgaaaagacagtttggaaaggatatgataattgttatggaacaacacttattggaattctggagaaatattggagaaaaaatcagcatattgtcagaggctgaaagagagagaatatggatggctgttaaggagaagtatttaagacctaatgtacgtataggttattcaatattcgatgctgtggttttttcttcaatggttggtattgatgttccggattcttggagatggattggagattttattaaaagtgactcaattattctgttttttaataaagatatggggaataatttttatgagattgagaatggaagtaagtttgttgagttttatgacgagtgtggggtgatagaattttatattacggatcgagatgcaaattacttattaggttataatcattcacaatgtctatttactatgggaactgcatgtgaatggttagaaaatgataagaggtataaagcaagatatccaaagtaaaagacttacgggaaatctttcttcactcatttgataatcaagaatttgatgattaatcgggttgtaaataatgtttaatgtaaatagaataaccattctaaaagactgttaataatttccctgaattgctagaaacatcttgtttgagccccgctcgccataacaagctataatagatttaaacattgttcattatttatgtatccataagtaaaaccatcaaaccgccgccggattcaagtttaattttgcggcggttttaagttcgaacttgtgtttgcaccccgcccgccagtatccgagggtcgatgccacccctaatatcaacaatccgatcttgatagagaaggccactgtatatggttatgatgtgatgaaccgtttgtcagaagcaacgtatcactgtgacacagaacagtatacttatgatctggcagggaaccggttaaccaagaagacccaaaccggagaagaacgatatcagtataaccgtaaaaatcaactgacagggctggaatcagaatcaaaccgcatggtttatctctatgataagcaggggaatctggtgtcagaacagagaaaggatgtcagccgaacctatgcttatgatcctttgaaccggcagaacagcgtaaccgcggaaaagggtgctgccagctatcggtacgatggagaaggcatgcgttatgaaacggaagaagcaggaaaggtgatccgttttgtatttgaccggggagaattagtgacagaagagagtggttcggaacagaaacgttattgccgcggacatcatgtggtgtcattgcaaagtgcaagagaggactccccgcactattttgtgtgtgatgagatgggaagtacgatatttctgttggatcaggaacaggagatcagaaaaagctaccactatgacccgtttggaagtataatagaaacgtcaggaagtatagaaaaccgaattacctatacgggtcagatgtatgatggaatcagcggtcaatactacttgagggcgaggttttataatccgaagatcggcagatttatgcaggaggatgcgtaccggggatatggactgaacctctatgcttattgtcagaataatcctattacttactatgatcccagtggttatctggggctgtgtccggcggggaagaataatccgcaggcggagtagactgagggttcgagacagtcatattcatcagctggagatattccaaaagatattctagatacaaaacctaaaaattcaccagatgtgaaaaagtggtatgacaaaggtggaaaaatttccatagacacagatgggacatggacatacaatgattgggaaggaaataaagttagttatcccgatggatatcctgattttatggctgcggggatggtaaatcaagaagctgatataggaccgtttcaaggtagaaataaagattttcaaactgccaaagatttaggctatattaagagtgaagatggtacgtggcaccatcatcaagatggaaagaccttgcaagatgtgatttcaattattcacgataggtttagacatcgagggggatatcaaagatgaaaagtaataattaatatcttctttttatgaacatacaaataattaaaatactatgaaataaggaggataacatatgttatcaagttttgggagtttggatagtaaagatttagaagtatttcaaagaaacaacaatctagatttacctgatgattataaagaatatttattgagaaataatggcgggagtgccaatgatgagattgtttgctttaatgctgaaaagatagcagaaccgattgctctagggtcgttatttggggtgggtaatgctaaagaaagtttatctattgaaacatggctgaatgagtatagggatgaattactagaaaatatgttaattataggacatgcaacaggaagtggtctggttttgttagtgaatcaagaagattggaaaggaatctatttttgggataattgtttagattatgaaaattctacagaagatgaatgcatgtattttgttgcaaaaacttttatagaatttttaaatggattatttttatataaagaataaaaaattattggctttactaagaaaaatgcaattttaataaggatgttaccatacattacaaactttgtttaataattaaatttagaacacaggagtcgctttatttcagcgatccggatgagaaaggtgcgaaagatatcaactgtgtacgtgcggcagcctctcggcagacagccgttatggccgatccaaactcggatcaacaccagaaggtttagcagaacaacaatcattcctagattatgagcaaagtaaaaggttttatttagaagtaatggaaggcaagagaaataactcctaaatcggagcattctcttgcctttctattatttgcatactgaaaagatggaatattctttgatattattcaggggaggaacagcataatttagaggatagcactacagtgggtcgatacaacaagtaaaattaaaagatagattgttggtaggaactatatttatggattaatgtagataggctttttgaaagcatatttaaaaatgtcataaaaagtaaggaagagtttaccagtatgggggtgaactcttcttttcaaaaaaaccacttatggtaaactggactggagaggggctacagagggagaaatactcttgctgtagttcctctttttctctttttctgttcttttcacccattagtttattgtagataggctgtcgaacctatggacgggtgagactgaatataccgagtacacatataatgcatcaggtaaaacagcagggggctataccggtaaggggcaggcccaaaaaagagaggcggcgcagtcctttcagtatgatgcccagggaaatattacaggagtcagggatgggaatgagaacctgacccagtttgtccttgatgactggggaggattacagaggtatatacacccgatggaggaatcgaacgttatgcctatgattatgccggtaatatcatcagtactactgatgccaacggaggaacgattacttataagtataatagctttggccaggtgtatgaacgggttgatcaggaaggaaacagtgaatatttttattatgatgaagaaggccgtccagacctctgcatagaccggaatgacaatcatattactacccactacaatatggacaatcatctggtataccgccgggccgaggatgggaaaggaagatatgccgttaccaatcagtatcactattatccaaacggcaggttaaaagagtcggcagcggatggaattacctatcaatacgattacacagccacggggctgttaagcaggaagtcatcagccgggagatcgttactgtcgtatgattatgacaagaatggaaatgtaatagaactgacagatgtaacagggattgcaacccggtatacctacgatgttcttaaccgggtcagagaggtgagagacagtcaaaaccatacatttctggcagcgtatcaatatacgccggaagggaggatccgttcccttgcctacgggaatggagtcaaaacagagtatcaataccaggacgatgggctgatggagcatctggtgacagtaggctctgacgggaaagtactgcttaattatgcatatgcctatgacggaaatggaaactgcacgaaaaagtcaggggatgtttatcagaatgcatatggttatgatgtaatgaaccgtttgtcagaagcaacgtatcacggtgacacagaacagtttacttatgatctggcagggaaccggttaaccaggaagacccaaaccggagaagaacgatatgagtataactgtaaaaatcaactgacagggctggaaacagaatcagaccacatggtttatctctatgacaagcaggggaatctggtgtcagaacagggaaaggatgtcagccgaacctatgcttatgatcctttgaaccggcagaacagcgtgaccgcggaaaaaggtgctgccagctatcggtacgatggagaaggcctgcgttatgaaacggaagaagcaggaaaggtaatccgttttgtatttgaccggggagaattagcggcagaagagagtggtttggaacagaaacgttattgccgcggacatcatgtggtgtcactgcaaaatgcaagagaggactccctccactattttgtgtgtgatgagatgggaagtacgatatatctgttggatcaggaacaggagatcagaaaaagctaccattatgatccgtttggaagtataatagaaacgtcaggaagtatagaaaaccgaattacctatacgggtcagatgcatgatggaatcagtggtcaatactacttgagggcgaggttttataatccgaagatcggcagatttattcaggaggatgcgtaccggggagatggactgaacctttatgcttattgtcagaataatcctattacttactatgatcccagtggttatatggggctgtgtccggcggggaagaataatccgcaggaggagcagactgagggttcgggtaagacaagagttggacggtggatgtcacaagcggaatatgataaaatggttgaaactggtcatgtacagatgtcgggagataataaagttcatgttgcaaatcctgcggatatagaggcatttggtaaacaagcaccaaaaggttcaatatacgttgaatttgatgtatctagcaatacaatgtctcttggtggtacagatggttggggaattattaatggtccaggttcgctattagatagactaaatgccaaaaaagggttgccacgaataacagaaatgccccaagtctcaaatatagaaattaaagggagtaaataaatatgagcaactatacttatgaacaaattaaagaaattgtgttgaaatggagtcagaatgatatatctaagcaactagccgaagatgattatgttgaaataaccaaaaatgaagaagaggtattattgattgatttaacatttgaatattgtttggctcagattgtagtgtccaagccaatttttgcaccctatcaatatgtatcttttgaggcaatgacattagaatctaaaaaaacacaggaaaccgggaaaccggaaatggtttattttttctatgattctgctgaaatgatggaaaatgaggttttaaatgaactaaattttggtgtcaaaatttgttctgaatacttaccagaccagttaagagaaatgtatttcaataaaaaaggtctattggctataataaatgaaaacttatgtcatgtaatgcatcctgatgatatcaaaaaatatgacaaagatttggttgctggtaattttgtttgtacggatatagaatctcaatatttagttgttaaaaacaatttaattacactaagagttttaccacaagtgtttataattaaatgagattttgaattacaaagttaaaactatagttagcggtttataatttaaatatgcacagtagttttagatatttctaaactactgtgcttttgtactatagaatttttaaaaatctcattatttttattccatctagaaatccttgctgatataagtatggttcttccaatgtaagcgcttaataaaacagtgccttatatattgattaagatccatgtcataattaattccatataattagagctttttgagttatagtttttcaagtttttcaagctctaggaatggaggcatttatggatcaagttactcaaacaaaagttttattccgcagagaacaatggaaaaagatcattgcggaatgccaggccagtggccttcccgttaagacctggtgtgaccagaatggtttcaaagaacagtcctattattattaccttaagaagattcgtgaacaggaaatcgaaaagattcctgtagcactgcctgatccaatggagaaaccggttttatttaaaaagttggaggtgcaaacacctattcatacacaagctgctgtaatcatacatcttccggctgcatcacttgaaatacacaatggtgccacgcagcagatcattgagactgtgctccttgcactgaactgcttatgttaggagatattactattgcaaaggacatttacattgcctgcggttataccgatatgcgtaagtcgattgacggacttgccgctgtcgtacaggagcagtttcacttaaatccttttaccccatcactttacctattctgtggaaaacgccgtgacaggatcaaatgcctgctgtgggaaggagatggattctgccttttatacaagcgcctggagaatggaagcttccgctggccgcgctcggaggaagacgtaaagcctatcacatggcaacagttccgctggctgatggaaggtcttgaactggaacagaaaacggttattctgccagctaaaccggcttcgttctgttagcttccagtgccagaaaagcctgtatttactggctttttagctacttttgtggtataattattgtatcaaaaatatagggatgaaactataatggacaataaagaggcttatatcatgcacctcgaaaacacaatacaagacctacagaatcagataagcaacttaaatgaaatagtcctgtttctccgtaaagagaagtttggttcttccagtgaaaaaactccaaaggaagaaatcgatggtcagctttctttattcaacgaagctgaaatggaagcagatgcttctcttcctgagcctatagtaaaggacgtcaaaggttataaacgtaaaaatacaaaaaccaaacgcgaagaactgatcaaagatcttcctataagagaagttccgtgtacactaccagaagatgagcagttctgtgatcagtgtggtacactattaaaagtacttggtacacaggttctgcgtgaagagctggaatacattccggcaaaacttcggatcgtcaggtacatacagactgtttatgaatgttcgaaatgtaagcgctctgagcatccatatattgtgaaggcagaaactccaacatcacttatgaatcattcccttgcatctgcgagttccgtggcaaatgtcatgtaccaaaagtatgtcaatagcatccctctttaccgacaggaaaaggattgggaacagctggggattgctctaagcagagcaactatggctaactggattattcgatgctcggatgactattttaaaccaatcatcgaccaccttcagcaaaagctgttggaacgcgatgttatccattgcgatgaaacgcctgtccaagtccttaaggaggagggtaagaaaccacagacgaaatcttacatgtggttatactgtaccggtaatgatggaaaagaaccaattgttctttacgattaccagccttcccgaaacggggacaatgcagtaaacttcctgaagaacttcaaagggtatgtccattcagatggatactccggatacaacaaactttccggaataacccgttgcggctgttgggctcacctacgaagaaaatttgtagaagccatctctacaaagaaagccgagggggcttcattgactcaggctgaaatcggaagggattactgcaatcagctttttaaaatcgaagaaggattaaaagatcttaccacagaagaacgattaagcaagcgtcttgaactagaaaaaccagttcttgaggccttttggtgttggcttgataaccttaattatctcaagggatctgcccttggaaaggcagttgtctatgcaaagaaccagaaacctaacatggagaattatcttcttgatgggagatgttccatttcaaacaatgcagctgaaaatgccattcgtccatttaccgtggggcgaaaaaactggctgttcgcagacactccaaaaggagcgaatgcgtctgctgctgtatacagtatcgtcgagaccgcaaaagcaaatggtcttaatgtatatacctacttagagtatttattactttacatgcctgacactgattggcgaaaccatccagaattacttgatgatctgatgccgtggtcagcggatgtacaaagtgaatgtaagaggtaaggctcagggttggttattataactgatcctgtttttaattttaaaggcactcttttattaagcgcttaccttccaatgcaagataatctgaaaattgatcaatgtaattttgtaccaggattctctccatgttaggcaggttattaatgaataattctgcttggagaatttgattatctttcttctttgaattgccggtctgatttttacggaatgtatcaattaacatgttgatacgctcctgaataaacatgtccattaattctttttcagtcatatttcatacctcctttgacaccatacattatcgtaagggtttcagaaagtcgatatcaaaaatcactaaaagttgatattgtaaattgggtaaacagatcaagtgaattcactgggtaaggttttataggagttaatcataactccggaactctttcgcataaatggcattccctgcaagtgcgaccccggcaacgacctcaataacagaaataagaccccggtgaaaaagtcctttcagtccgcattgcgggctgatgtaatccgagtcggggaagtcttttgaccccggctctttaacctgcatcattttcgaccccatggttcacctctgttttggggcaagaaattggctgagattatccattaccagattataaaagtggttgcagatgtgcgacctggtgcattgcggaagctggcatatatgcgacattcttctgataaagtaacaggaagatgaacagtaggtagcggtaatacaaacatttatcagataaaaaggaaaacgcaattcttttcaaatatgcccaacaaggcttagtaaggcttgaatggcatatatttctaccatcggttttaaaggtcacacaggggcgatattttgcgacacagggctaacagggaatgggacatcaaatctgcgttgccattggtttgtgatatctacccacccacatggttcatggtgaaccatggaatttacaggaaatcggttctatggtaaaatggggctgccgggggttacagggggtataaattgcctttctgtagctcccttttccgttcttttttctgccatttcttctcctgaaaataaatccagaaatgacttgcaatcaaatcgatagagagttaacatgaacaaccaataaaagagataacttgtcctttcacccattggtttgttgtagataggctgtcgaacccttgtggactcaatatgagttaacgctgtcatctgaggttgccggtacggggactgattggttggaaacaagtaggagggggcaaattgcagaaaagagaaaatttgctttatgtagggattgacctgcataaggaaacacataccgcagtgatggtaaactgctggaatgaaaagttagaggttgttgtgatagaaaacaagcccagtgaatttaaaaagctggcagaaaaggtgaacagaaaatccagtattcttggattaaatcccatttatgggctagagaatgcttacggttatggaagaagcttagctgtttggctcattgaaaatggttacattgtaaaagacatcaatcctgccctggcttatgaccagagaaaaagtgcacccatgtaccgaaaaaatgatgagtatgatgcgtattgtgtggcaacggttctgattaatcagttacatactttgccggatgcaaagccgaaagataacgaatggacactggctcaactggtgaatcgaagagatttattggtgaaagatggtatccgttttaaaaatggactccatgagcagatatccatggcatatcccagttacagtaaatttttcagcgagatagacgggaaatgtgcgatgtatttctggaagacctacccgtcccctgtccatttgcaggaaaaaacagcagaagaactaacaatggaatttaaagaaatatctcgtattaccaaaaaagataaagcagagttgattctggattgtgttcagaatgatggaaatacctttcgggaatatcaggaatccagagactttatcacaacaagtctggtaagagacttggaacatcagaaagaagaattggcagggcttgataaagaaatcgagaaaatcctgcttagttttgattacaaactgaccagtatgccgggaataggaacttctattgccagtaagctgattgcagaaatcggagatatccgaagattttccaatgctgataagctggcaagattcgcaggagtggctcatgtaaagttcagttccgctggaaaaggcaaggagcaaagctccagacagggaaaccgccagttgcatggactgttttatttcctggcggtaaccatggtgtccagaccaaagaacggagcacccaatcatccggtattttatgactattatatgcggaaaatcggtgaaggtaagacaaagtctcaggcactggtctgcatcatgcgccgattggtgaacatagtgtacggaattatgaaaaataagacagaataccgggaaccactgccagaaaaagaatagtaatttttctatttaaaaacagcacaaagacgtgctataatttttttaattgaataaagattttcaccgttcgtcggatatctcagtactccacctgagggttcggggcaatctggattaagtgaagcagaaccagtaaaagtatatcgagcggttggacctgaggaatttgatgatatatttgattatgaaggatttaggggtagaccagatggacgttcatatgaagctaagcaatttggtaataattttgatgaaatattggatttagctaatcaacctataatgagagatactgccgcaattgtcgaagtgacaataccccaaaatatctataaccaattaaatcacatgccattagatgtgggaattttaaagtctggtgcagtaactgttgaaccagatatgttggatatatttaacaggagcataattaatattgaacatgtttattaaaaggagttatagtgatgctgatttttgaagcaaacgtgatcttatattgtaaatatgtgtcaggaccatcaataatgtctggtgtaagatgttcattaaatatagatggaaatgcccatatttgtcaaattgaaactgtagatggtgaagatattcctttagatactgaaacttgtgttaaaattacgacaataagtggagaaatcagtcttttgtcattagtaataaatgccgattttatattactaagaggaaaagaaataggaaaagggcatataactagattagtagaggcttatttagaaaagaaatatttggaaacaatagtggataaatcattactcaaaaaaataattgattatgcagaaaatatgcctaatgcattagtgtatgatgatgtttatgaattattaaagtgatagaacaaggaagttctaaaagttttgttttgtttgtaaaactctctatactatcaaattgagtatttatattagtttggaagtatagagaacatatagtcgttatttttataaaaattatagtttataaaaaaatttacaaacctaatagcatcaataaatccatactggtatagaaaactttcttctaagacgagtataggcgtatgaaagggtccatgtaattttcaattaatgctttttctttgcatggcaaatgttcaatgaagatttcagtgtgtataatttgctcatattccttctgggattgatcagactgtttttggtggaagatatcatttggcatattgatacgttcttgaataaatatatcgagtaattcctgctcggtcataatgtttccctcctttgagaatatacgatacccaaattattgtagtacgtcgataccagaaatcactaataataagtctcaaaaacagcagaaatgaacgatatatataataggtggatgttcaagagcaccttagaaacaccttaatagcgtggtttattggtggctacagcacccttgacagtacaaaagatgatttacagcaccgtacaccagcttcgaaaacgcccgcactgcgggtgtttgtgagcggaaggggcccatttagggtaccttcctttatcctgctttattttcgaccagataaatatagactgaagtttgtattcggataggttttgtgtatgatttgtgatacagcaatttatcagcctttggaggaaaccgtatcagcaagattgttggcaggaggctttccaaattgacccacatttgggttttagtatgataatggtcaacttaccgggtgttatgtcaagggcacacaggggcaacacgagcgtataatgggctgataaaaaagggttgccagtaggaattgcggatagtgagctaagtcgatggtacttctcaagccatgtctaagtttgtacactagaaattgattctaaacaagccccatcatggcttgtcattactggaaaaatatcattatttgtcactaatgacattcatttggcatggaaaaagggtgtggacagactggattccttaataatctgatttctataatgaattaaaactcctattaatttaattgatccgaaaaaataatgtgatacaatttcctgatgtcagaggagaagatgtagctgtagcggcaattattggtggtgtggcatatggaatctggtggttagttaaggctggagtaacattctctacaggagttcctgtgttggcttgcccattttaaaggaggattattgtgcaaaaaggaaagataattaaagaaatcattggaaaagtattagaaccagaggactttgtttttgataaagagataaagaactgggggtttataaaggagtttaaaaatagtaagggggagattgcaagacaaacagttacgttttggactagtagatttgaaaaaaaaatatatatggatattaactgtttttcgggaggaatttatacctatggtttaaaccaatttgctccagggtatacaaatgacggacttatattctccacagatgaagaatttaaacaagtgattgaaacttatgcaaatattcttaaacagtatggtttagagttcttaaaggaaatagcagagccaaaacgaagtgattattttcgacaggaagatgactataagctatttgaagagcatgaatctttaactcaaaaatatatgacagatcagcagattaatatggattgtatcacaatagaagatgcggtaaagctaatgaaagatatggtgtcagagaagcaggcagaaccatttgaggattgtcgagagctttttttagaaatggcagcattttatggaggtgtggtgagaaaaacctattcatgtaagtggataatgaaagatatgaaaattcaagctatttgcaaactagaaattgattcaaaattaaaactatcgttatttgtatctaataaaattcatttggcatggaaaaatggtgtagaccagcttgattccttgataatttgattgctgcgatagtagttattacttaatgattcttgagtttgcattgatgataatatgtcttctggtacacattcgattgggatgaattagatgttgtattagaagatataaaaaagtgaaagcagcaatgcagataaacataaaagaaagaacaataactaaacccaagttgaggagccgctgcgatgtcgcatctcgcttttaattgatttttttgatgctgttctggcgtgatgatttcaaaaggttttttatcacgaaggacttgtaaagatgatgttacaaattttatgtataactgctccgacagctaccattttctttttgattcacctttttgaagtagtaatccctggtaccttgattcgtactcacaagggaatgaatatcttccagaatagaagagatttctgcattatactggcggataaaacggatatagattttgatccgcttaaagttgctgctgacagaatggccaaatacttttgtgaatttggaagcgtttataatggcgtcacatttatcagagagataaaaagccccaaaacgtgcagtcgagcgcatggaagcaatgatgtcatctctggaggcggcaagaaaggcatctggagaagtataggcttccagaatagtcatagcagtattggtgttaacttttgaaaagatgcctaagatctggggtaataccatgcacagttctccctgcagcttattcacataagcagaacggttgttcatcagatcataatactcccaaaaatcttaggatacttctttcatctaatcaaccattgtttacataataatgcctgattaaaatagcaccaatcacatctgcaaccgcccaaccaataggaatcgcccaccatatcccgacaattccgatccggctcacagaggagagggcataagccaggataaccctgatgccaaggcttacaacagtaagtatgatggacactcctggctttccaattccccggaacagtccgtaaaacataaataaatacccgatcaggcaataaaaaccggctacaatgaaaagatattgtactccaatccccaatatctctgtttcatttttattaataaaaatgtacatcagaggctttgcaaacaccaatataagaacggagatcaaagcacagtaaatggttattattttcactgcagagcgtattcctgtgtaaatacgcttttgttttccagcccctatattttgagcaataaaagtagaaaatgcattgccgaaatcctgcacaggcatataagcaaagctttctattttaacaactgctgcaaaggccgccattgcagacacaccaaagctgtttaccagactctgtatcattaatattccgaaattcataaccgaatactggatgctggagagtatggagaaattagaaattctctttacaacacttttatttaaatacaaatgtttccgtttaaggcggattagaggaactcgcagtatacaaaaaacagcaataccaatacctgaaaagccttgtgcaatgattgtggcataggctgcgccggcgatccccatctgaaggggaacaacaaatatgatatccaatacgatattaataacagcagataagataagaaaaacaagcggcaccacggaattgccgatactcctcatggcagcactaaagtaattgtaaatataggtaaagctgattccataaaaaatgatctccaaataagtccttgagtcctctaaaacctcctggggaatattgatcaaggttaaaattttatcaataaaaatgatagagcatagattgatgattattgtaacgattccaataaaaataaaagcagtgaagaaataatttttcagcttgtctatttcgtttgcgccaaaaatcaaagaaaataccacgctgctgcccatgcagaatccaatgatgatggaagttaataaaaccataacggaaaacgaactgcctaccgcagcaagagcattggagccgatgaactttcccacaataaccgtatcggcaacattatataattgctgaaatatattgccgatgatcatggggatggcgaagtttatcatggcctttgtttcattgccgttgatcagatctcttgtagcattcattttactcttaaaatcctttcaaattattcattgcggcagggaaattcatctgtgaataagtttaaaaatttgttatgtaatatatacccttatatatgcaatgcataaaggttaccattagaaaatccttttgtcaataagtacagaaataacgatatgaatagaggagccttatcatagacggaacatgaagactcctataaagaccgtgtgaaagtcctttaactgccttttgaatcagctgaaaagaaattaaaaaatattggatatgccatgccatgaaattgatgttctttttctcgtaaccggacgttcagaaatgagcgtccttttcgtttgaaatccgaaagactttgtccaatccgttcctccccccatcttatgcggtaactccatcatgtatcagatgatattcccggccattactataatataacactccaaaattccacagcaccctccaaaaaagcatgtaaaatcacagagtcaacccatggaattgaaaaataattaacaacatcgttaattaaatgcctaataacacaaaaatcattgtgctaaacatacaaaaattaaaaatcagattatctggtttggctgatgtattgtaataaaaatttctataaaataaaaccatggattcgaatcgatagaaaaaagattcaggaggtagcaaaatggatatttccgtcaatgagatcaaggaaatgctggactggatgtcctcttatggaaaaaaccagacaggagggatgaccaggctcctttattccaagagctggcttgaggtacagctggctttaaaggagaaatttgagcaaataggcatggaaaccagatttgatgaagtggggaatttatatggaaggatcattggaacggagccggaatccggaaccattgccaccggttcccatgtggatacggtagtgaacggagggaatttagacggccagcttggaattttcggaggatacttagctgtaaaaaacctgctggaaacctatggaaggccgaaaaggaatctggaggtcatttccatggcagaagaggagggaagcagatttccatatgttttctgggggagcaagaacctgtttggactggctaagaaggaagaagttgaaaatctcacagattcacaaggaatcagatttgcagatgccatgcatgagtgcggatttgactttaaaaaagattccggcggttccatggatgatgtaaaggcatttatagagcttcacattgagcaggggaatactcttgagatggaaggaaaatccgtaggagtgatcaccggcatcgtagggcagagaagatataacatcaccttaaagggtgaggccaatcatgccggtacgactctcatgaaatacaggaaagacgtaatccaggtattttcagagatcgtctacaattccttaattaaagcgagagcaataggtgatccgctggtattgacctttggaaaaattgaagtcaaaccaaatacggtgaatgtagttcccggggaagctctgtttaccatggactgccgccatacggatcaggcacttttaataagcattacgactgagctggaagagaacatgaagcagatcgcagaaaagcatggggtggaaataaatatcgacttatggatggatgagcagcctgttcccatgaatgacgaaatgatccggctcattgagaaggtctgcagggaaaatggactgaattaccggatgatgcacagcggtgcgggccatgattctcagatcatagcgcccaggattcctgccggaatgctctttgtcccaagcatgaaagggatcagccataatccggcggaacggacggagctgccggatttgaaacagggaatagaagctttaaagtcatctctatatgaattatcatatcaataggaaaagtgaggggcattatgggagatcaaagtttaacaaaacaattgccaaaggattattggaaaacaatcgtatttactttctgcttgggctgggtggtcatctggatctaccgttccatgctgtcgcccatctatacggagatacaggggacggtgggacagcattccaatacggctatggggcttattgcaagctgttatttctttggatatacgtcgttgcagattccatccgggttcttagttgacagattcggacagaaaaaggttctcataccgggatttctcctctttgcgttaggagccttcagcattgccatgtcaaagtcccttcatacgatttacataggcagcgtttgcgccggtatcggctgcggaacttattatggagctgcgttttccttaactgcggaacacgtgccgcctgagaaaaagggtatctccacggccatcgtcaacagcggttctgcactgggcctgatccttggaatgacaggttccagctttattgttaagaccttgcatctgccctggcagacaatggtgaccatatcagctagcttaatcgtgcttttggttatctggtttgccattgcaatcaaggacagaggaagacaccatgcagttcaaagaacagacagcaaaaaggcagaagaggtggattccggaaccgagaaaaaggcttccttactttctcttaacatgatttcctgctacatattgtatttttccacctgctacgcctattatctcattgtgacctggcttcctaaattcctggagtcagaaagagggatcaccggcggaatgattggcctggtggtttccatgatatctgttacagcagtacctggagcgctgttttttgcaggcttatccgataagttcagagggaaaaaggcgctgatcatcattggcctggaactgtccgccttcgtgctggtggccttatccatgtcaatgccaaatgcattatccttaaccgtcattttgctgctttatgggttcctgggcaagatggctgttgatccggttctgatctcttatgtgtcagacagagccaacaaaaagaacatggcaaccaccctggggctgtttaactttttcggaatgtcctcatccattatcgcaccggcggtaacaggatttattattgataaaacaggatcaggcaccgcaggattttatatcggagcattgcttcttattctgggaaccatactattcctgatatttaatgcaaggacatttttcagtaaggcaaaataattacaagataaaggagaaaaaaacatgagctatatcaatcagataacaggataccgggatgatattttatcaacccgttccatcgtaaagagaggaaattttgcattaattgagccggatggactggtgaaaaacgtgataccgggatttgagaaatgcgcagtgaccattttagcttcccctaagctgggagcttccttcgtagattatctggtgacaatggagcagggcggaggccatccaaagggatttggaggagatgggatcgaggtattcctctacattctggaaggaagggtaaaggtgaaaaatgaagataaggaagaagagctgacagaagggggatacatttattctcctgaaggcaatcaggtgtactttgaaaatgtgggagatattccggcaaaggcatttttatataagagacgctataacaggatcgagggccatgaagcctatactgtctgcggaaatatcggggatgtgccctttactccctatgaaggtatggaggatgtaggggtcaaggacttcctgccgtcagcctctgacattggatttgatatgaatttccatattttaagctttaagccaggcgcctgccacggctacattgaaacccatatccaggagcacggcgcctacatctattccggcgaaggaatgtataatctggacaatcactggatccctgttaaaaagggcgactatctgtttatgggcgcttacagcttgcaggcagcttacggagtagggcggaacgaagaatttgcctatgtatattcaaaagactgcaacagggatgcagagttataaggcagcgcacaaaatccctgaaaagtcagaagaagatataatcgaagaaaggttgggatatctcatgagattaacagaaggacaattacatgaactgatcagtaataagcttcaaaaagcagggcttacaaaggagcacggggacattaccgcagatatcctcacatggtctgatgcaagggggatccattcccacggagccgtcagggtagagtattattccgaaagaatcgcaaagggcggtattaccattcatccggaatttaagtttgagaaaacaggcccggcaagcgggatattccatggggacaatggctcaggctatgcggcggcagtgctttctatggaagaagcgatcaagatggcaaaggaaacgggagtagcagtggtgggagccaagcacatttctcacagcggaagcctgggatattatgtggaaatggctgcaaaggaagacttagtttccatttccatgtgccagtcagatccaatggcagtcccctacggaggatcggatccttactacggaacaaatccaatcgcttttggagcgccgggggctgacggcagaaatatcatatttgatatggctacaaccgtccaggcctggggaaaggtgctgtatgcccgctcaaaaaaggagtctatcccaagcacctgggcagtggatttcaatggaaatccaaccactgattccacactggtaaatgcgcttgttcccattgcaggcgcaaagggctatggactcatgatgatggttgacatgctttcaggcatccttttaggccttccctttggaaagcatgtgagcagcatgtatgaagatttatcaaagggcagggatttggggcagcttcacattgtgctggatcccaataaatttgtgggcctggaaagatttaaggaaaacataaccgccaccatggaggaactggctgccattaaaccggcagaaggctttgacaaggtgtattatccgggagaacggggacttttgagaaaggcagactatgacaagaacgggatagagatcgtagacgatatctatcaatatctgatcagcgaagatgttcattatgaccgctatgaccataagaataaatttgctgaataagaggttaaaaggagagtagtaacatgattaaaacgataattcgcaaaggaagctatcaggattccgtggttcttatgttgctgaccaataaaatttccgccatggaaggaatacataaagtctccattatgatggcaacacctgccaacaaggacttatttaaggccagcggcctggagactcctgaattagcggaagcccagtccaatgatatggctattgtggtggatgtggagtcagaggtgcttgtagaacaggtattaaaggagacggaaggatttctcaataaccagtccaaaagcacttccggaaatgaagaaaaccaaacagtgactacctgggaacaggcgttaaaaagattgccggatgccaatctggcggtcctgtctatacctggcatgtatgcggcagccgaggctgacagggcgcttgatgaaaatttgaatgtatttattttcagcgacaacgtatcaaaaaaagatgaaatatctttaaaacaaaaggctcatgaaaagggacttctggttatgggaccggattgcggaaccggcatcatcaaggggtgcccattgcttttaccaaccatgtgagaccgggaaagatcggggtcatcggcgcttccggcacagggatccaggaggttacgaccatcattgaccagctgggagaaggcgtggcaaatgccatcggcacaggcggcagggatttatcggctgaggtgggaggaatcaccatgctggatgccattgatgccatggaaaaggataccgaagtggaggtggttgtcatcctgtcaaagcccccggcaaaggaagtaagggatgcgatcgtaaaaaggctctgggactatgaaaagcctgtggtgaccttgtttcttggggaaaagccggaaatacacgaggagaacttctaccatgcctacaccctggatgaagcagccaggatcgcagtttccttagtgagaaaagaagagatcgtccaggatacatggaagccggaggtgggggaaggatttaaaaaggaagaccacaaaaccataaaaggctattattccggaggaactttggcggcagaggcggtaatgctcataaaggataccattggcattgccggtgcaggaggaaaaaaggaaggtttcatgctcaatacacagggctataccatcattgatctgggagatgacgtctataccgtgggaaaaccccatccaatgatcgaccccacaaacaggatcgtttgtatgaagcaggctctggaggaagaagagacgggtgttattttatttgatcttgtgctgggatatggttctcatgaagacatggcaggagcccttcttccaggaatcagggatatgatggagcaggtaaaaaagcaagggcaaaaggtcttctttgtggcagccatctgcggaaccagagaagataagcaaaattatgatctccagaagaaaaagctggaggatataggcgtcatcctttgcaccagcaataaaagagcggtggaaacggccctctgtctcatcggtcacccttatacagaaacggagaagacgatccttccaagggaaaaggtgaaggcagacagggagcatgccgtatcaaagcagatgatggaattgctctcccaaaagcccagggtcattaatattgggttaaaaagctttaccgacgtgctggaggaattctcctgcaaggcagtgcagtatcagtggacaccgccggcaggaggggatttggagctgatcaaggtcctgcagtatttaagaggctacaagttttccaggcagtaatggaccggaaaagtcttatgtggatatgaggaggttcttatgttgtacgatacaatagacgatgcaaatcaggcagtcatacagaaaatgatccttgcttcaccggttttactggatgtggtgcctgccaagacagtaatcaaggaattaaatcagggaaaggtgcttctccatgcgggtccgcctatccgatgggaaaatatgaccagtcctatgaaaggatcctgtatcggtgcggccttgtttgaaaagtgggcttccaccaaggaggaagcggtggagcttttaagccgtggggaagtggatttcatcccctgccatcacgtggatgccgtaggacctatggggggaatcacctctgcaaacatgccggtatttgtagtggaaaataccaccgacggaaataaggcttactgcaccatgaatgaaggaattggaaaggtactccggtttggcgcatactccagagaagtggtcttacggttaggctggatgagagatgtgctgggaccggtgctttccatggcccttaagaagctggaaaaagggcttgccatcaaccccatgatcgcaaaggccattgccatgggagatgaattccaccaaaggaatatagcggcttccctcctgttcttaaaagaaatgtcccctgtcatagcgggcctttccatagaggaagagaagaaaaaggaagtcattcagtttcttgccgatacggaccagttcttcttaaacatcatgatggcagcggccaaggcggtgatggatggcgcacgtttgatcacggaaggaaccattgtgacggcaatgtgcaggaatggagaaaactttggaatcaggatcagcggcatgaaggatgagtggttcactgcgccggtcaatactccccagggcctttactttaccggatattccggtgaggatgccagccctgacataggagacagcgccattacggaaacctttggggtaggcggaatggctatgatcgcggcgccggcagttaccaggtttgttggaacaggcggttttcatgatgcacttcgcatcagcaatgaaatgatggagatcgtcatcagccaaaaccctaactttgccattcccacatggaatttccagggcacctgcctggggattgatgcaagaaaggtggtagaaacagggatcactcctgttatcaatacagggattgcccataaggaagccggtgtgggacagataggagctggaacggtccatccccccgtcgaatgtttccaaaaggcagtcatggcttatgggaaaaagctgggatataaagggtgaggatatgagaagcttatcaggaaagctggcagcgtcagagctgttagaagcattaaaagaaggtgaagcttacagggtccacagtcagtttgatagcggctgtaatctggcgtttcctcctttcctttgctttattggaaataaaaacaatgccctggttccttatggcattttactggatgaggaggatctgcctgtatttttggaacaggcagctttctccccctgtttccgttgggatgagaaggaacagaccttgtattcggattccatccgcctttgcttaaaagactcccggatatacagcagctttatccggaaaaaggagtatgccatagaccgggaagggattaccatgtttgaagattttattgactggaatcttcctacaggatttggggaatccattggctcctttatggcggcagagaaagaggaagtggatgaattgtaccaggcattttcaaaaccaaaagaagaggctgaaaagaccataaaaaggtggatcggaagagggatgggcttaacgccgtcaggtgatgatttccttatggggattttatatgtggacagaatttctcccatactggaaatgccctttctccaggccttaaaggagctgattgaccgccaatatacaactgatatcagcgggcactattatcattgtgcattggaagggtattttaataacgctttggtggagctggtggatgctttgattcagaaaaattcttcacaaatgaagaaatgtatggacaggataaggatgataggttctacctctggctgtgatttgattttaggtatggcagcaggggtcgattatgtcaaaggtgaggcaaacatataatgggaggtctgtgaatgaaaaaaatgaaattatctatgacagtacagatcatgatcgggatggccgggggctgcttcttggaatctgtctgggggataaggtgaaggatatcaagctcataggagatatcttcctgcggctcattcaaatgtctgtcgtggtaatgatcatgggagcggtcattgaatccgtagcgaatttagatcctaaggagttaggaagatttggcgtaaagatgctgttttggtttctcctgtccactgtgctggcagcagcggcaggagttgctttaggccagttctttttacctggaaaagggctttcccttcctgctgccggtcagatcgtccagactacggataaggggctttacaacattattcttgatttcttacccaccaacatcgttcagtccatggcagattccaatatgatccaggtgatcatattctccgtattattcggcgcgtccctcggggcctgccgcataaagaaggagagggtccagctcatgggagtcatcagggagttcaatgaagtgatattgggaatcgtacataaggtcatgaaactggctccctttgggatcggagcgctgcttgcttacactgcgggcactacaggcataaaagtcattatgccattgatcaagtttctccttttattcggatgcggctcactcctgtatctttgccttatgatcgcattcgtatcattttactgcaaggccaatccctttcatgtcggaagaaagctgggtaacatgacgatcgtggcatttaccacaacttcctccgccgtcaccctccccacgaaaatggaggacagtgagaagaagctgggagtcagcaagaaagtgtcaggcattgtcaatcccctgggaatgaccttaaacagcaatggtttatccatgtttcttgctttggcatgtgtcacagtctcccagatttacggtatccccttcccatgccccagctggtcagggtgatcgtcttatccaccttatcctgtcttggaactgtggcagtgcctggaggcggtctggtggccctggcaatcgttgtccccgccttgggccttcccctggaaagcattgcttttttatccagcattgactggttttcggggatgttccgcaccatattaaatgtagatattgatgccctggtcgccatgatgatagcaaaagatgaaaaggaactggattatgaaattttaaacgggagccaataatcagaggatcaatgaataaataccacattgccagaaaagaaaggacatagtataatgagcgcaagtgagcgaagatgagcttggtcatcggcgcgaacggcgaatgttgatcatgactcgaagagtcatgatataatgagcgcaagtgagcgaagatgagcttggtcatcggcgcgaacggtgaatgttgatcatgactcggaaacgattctgaatgtgaaaagagaggcatagtatgaccgttggaaaattgctggaagaaccaatctttcaaaacctgaaagtgctgaataataaggccgatttaagaagagagattttcacggttgagtctacggaaacgccggatgttgcgtcctatttacctgagaatacgttattgatcactaccgggatggcgtttaaggagaaccaggccggattatgtgagtttattctaagtctggaccgtctgccctgtgcagggcttgccattaagctggggcgctttatcgaccgcctggagccggaggtcattgaacttgcagaccagctgggatttcctctgatccagatcccctacaatatgacattgggggaggtgtttcagcagttactggcctatatctgggataatcagaatggggagctgacctttgccttaaacacacagaaaaaattttccgctttgcttcttcagggggcttctgcgggagttatgatgaataacctgggacttgtcatcaaaaagccggctgcattattaaatccctttggtgaggtggaatctgctacccatacgtgtcaaaaggaatatttaagagcagcgcagaacctgttttatgatttgtctttttatgaaagaaagacagacagctttgaaaacttcatccatgtgtcaaaggtaaaggaaaaggtctccatctatccaatacaaaccgtgggaaaaaatccatattatctttatatttttggcggtgaggggaaagaagataccatgtccggcatggtgatcgagcagctggtgctggtgtttggcatctttttgtataaaaacctgtacgtgagatgcaatccgttaaagcagaaggaagcgattttgcatatccttgtgaataagcataagaaggagcggtggtcctctgcccagctgtttacggtgggagagaaatatgggttaaaaccggctgccggctataagataatcctggcgactttggagccctttgggggaagggaatttgatttcctgaacttatcccacagggaagaacggtacattttaatatatgactggctgaacaggaagctccaggagaaattccatggggatatcattatctttccggaaactctgacttaccagtatgttttgctgatacagggcaattacagggaactggaaaaagttttggaggattaccacgaggctttgctgcgttttcttaaagtttccatcaccttttcctttggcaatggagtgatggagctggaaaccattgacaattcttataatacggcactggaaagctaccagtacggggaagagaaggaagatatcccttatattaaatatttcaaatccaccgatgcaaatgaactgtttaaaatggtatccagcgagcagatcaaaggatactgtttataccatttaaaaggtttgacaaatcctgaggacgagatgaccttggagcttagaaggacgcttaaaacgtatctggactgcaggtgcagcgtcactgaaactgccaatcacatgttccttcacagaaatactgttaaataccggatcaagaaatgtgaagaaattcttggaagggaaatcgtagatgccaattactgctttcagctgcaattgagtctggtgctgctggagcagaatgggtgaaacacacttctgataaagaacttattaaaattgaaaagttttgccccccttaacgaggagaaacagtttcctcacaggctggattccttatatggccggtctgttacaaaggggggcattaacattttgcaagtctttacaaatgcttctatgctttctaagcttttatataggaagtttcctgtgtcatctcatggaactgcccatattcttctcatcaataaacttacggtcatacaaacgggcggcaatcagcactacaaatatggaacccgcattatggaccagggctccggtggttggagtcagaacccctgtaacagaaaggaagattgccgcaaagttgatgcaaagtgacaaggagatactgagcttaatggtactgactgcctcattggacagccttttgagataggggattttgctgatatcatcacccatgagggcaatatcagcggcatcaatggcaatgtcgcttcccatggttcccattgcaacgcctacgttggcagttttgagggcaggagcgtcattgataccgtcaccgatcatacagatgctgcgcccttctccctgtaatcgctgtatttccgctgctttttgggcggggaggagtcccgcatgaacatcatcgatcctggtctgatctgcaaaataccgggcagcctgttcgtggtcgcctgtaagcagaaccacctgtgtatgcatgttctttagttcttttatcatctcctttgacgtttcccgcagagtatctgacagagtgacagcgcccgccaattgtactccatatcccacaagaacgacagcctttccctggctggggaaccggtccaatatgagggaggcggcttcatcaacagggatctgatgttccttgataaagtccgggttgccgcacagcagcagcttcccgtttacctctgccctgatcccttttccggggatcatctgaaagttccctgcctccataagctctgccccctgttcgttcccataggcggtaatggcctttgccaaagggtgctctgaataaccttccgcagaagccgttaaactcagaagctgcttttgatccatatctttagaaaagggatagatatctgcaaccacaagactgcccttggtcaaagtcccggttttgtcgaaggcaatggtgtctgtttttcccatacgttccagtgcgtcaccggatttaatgataactccgtattttgtcgcctgcccgatggctgccatgactgccgtgggtgttgcaagcaccagggcgcagggacagaaaaccaccagcacggttacggcgcggacgatatcctttgaggcaacccctgtaatgaccgcaatgagcagagcaacaggcacaagccaggtggcccatttgtctgcgatgcgttccatgggggcttttttgtcttccgcctcccggaccatgcggataatcttttgcagggagctgtcttcaccgacttttgccccgcggatatcaacggcaccaaaacggttgatcgttccgcaaaacaccttatcccccggagccttgtcaacaggcagagactcaccggtcataacggcctggtcaatggaggttgcgccgcttatgatctctccatccaccggtacggtttcgccgggaaggatccgcaggatatcccccaccctgatatcttctgcattgatcatttcttctctgccgcctgtgatcctgcgcccctgctgcggagcaagattgatcagtttctgcagccctcttttggcacgttcagcagttttatcctccaggatagcaccaatagccatgataaaggcaacttccccggccgcaaagatatctccgattccaatagccgcaaacattgcaatggaaatgagcagtgcggaggagatttttttcatgcctggattgtgaatgatccgccataaggatagatagaccaaagggatcccgcagacaataattgagacccaggccgggtcagccggaagctgtgtatcaaaaagcatcagtacaagactgcccaggagaaatgcaccgccggtaagagtcatgggaacaccggacaaacagtcgtttattcgctttatcatcattaaatcctccctgtggatattcccttgcgctttttgcaaggaatggtataatctgttttatacagaacactttgtttggtattattataaataggaccgtgtccggcatcaatggataatttccatggaatgtttgttacggaacagttcttatagatttgttcggaggaggtttttatggacagacggcagcagaaaacaaggactgcgatatttgaggcgtttggtacgctgctttccgcaaagagttattcaaagatcacggttcaggatatcattgatgaggccaacgtgggcaggaccacattttatgcccactttgaaacaaaggatgacttattaaaagaaatgtgcgcggatttgttttcccatgttttttcagactctttaagtgcggagagcacccatgatttttcaatgaaaacaggcaatccttccgcaatgatcacccatattctctatcatctgcttgataataagagaaacattattggcatcctcacctgcgaaagcggtgaattatttttgggttttttcaggcagtatctcaatgagatgatggcggcgcggctgttgggggatacacccttattcggcaaaaaagtaccccatgaatttcttgtaaatcatatttccagttccttcgtgggcatggtacagtggtggatcaagaaccgcctggcccaaactccggaagaactggcagattattttatggcggttatcttgcccgttatttcttagtccttgtaacagacggccatttgattgaggttttattgtttttatttctaataaatgctatgattaaaaaaacatattcagcggagaaaagaggataagtatgaaattgattctgatcaggcacggggaaccggactattccattgattccctcacggaaaaaggctggaaagaggcagattttctatcccaaaggatcagtaagctgccggtttccgcattttactgctcccctcttggaagagcaaaggatactgcaaaggccaccttacaggcatcaggtgcagaggcagagatactgccctggctcagggagtttcatgcgcctgtggaggatggggcaggtgaaaccaagagaataccctgggactttatgcccggatactggaccaaccgggatgagctttaccacagggacttatggtttgaaaatgaaaaaatgaaaacaggaccagtcaaagaggaatataataaagtagcagccggccttgatgaaattttaaggaaatacggctatcagagagagggcagaatgtaccgggccgttcccggaagcgacgataccatcgtcctgttctgccattttggcgttatctgcgttatgctgtcccatcttttaggcatcccggccccacttttgtggcagggcttttttctggcaccttcctcagtcaccacactggaaacagaagagagggtggaaggagaggcttatttccggtgtaaaggagcaggggatacggctcatttatacgcaaaaggcgagccaacctcaaattccggctttttccccagatagaccgccggcattctgattaaaattataataggagattgccggacgccgggcagacatagaaagaatggatttggcacatattacggttaataaaattgtagaaatgttcattatcatgctgattggagctgccgcattaaaatcaggaattgccgatacgggaacaagtaagaaaatgtcctcaatcctgttaaatgtgatcactccctgtatgatcgtcatgtcctatcagatggaatttgacagggatctgttaataggcctgatggtcacggtgggggtatcgggagccagcttttttctggcgattctcctttccgggattctgataaaagccagggaaaacccggaaatggcggtggaaagaatttccatggtctattctaactgcggttttgtgggcattcccattatcagcgggctgctgggaataaaaggcgtgttttttatgacagcttatataaccgtattcaatatcctgatctggtcccatggaatcatgctcatgaagggcagggatggaaagctcatgtcaaccataaaaaatttcatcaatccatccaccgtggcgatcggagcagggattctcttttttgtaaagggaattcgtttgccggaggtagtaggaaatccattgtcaatgatcggggccatgaacacgccggtggcaatgctggtttccggtatgaatctggcggaaagtgaactgctttcctgtttaaaaagtcccaggacctatatgatcagcgcagcaaaactccttgtgatccctctcatgaccctgctgcttcttttggcagtcagggtggatcatgccattgcaatcaccattttagttgcctccgcctgtcccagcgcagctacgggagccatgtttgccctgcagtataacaagaacagccagtatgcctcaaaattattggcagtgacaacggttttatcactggttaccatacctgccgtcatgctggttggaggaatggttttataaataaggaagaggtgggaacctgtaaatccattggtatcgtgtatcattgataaaaggggaaaacgccctgcagattttttaaacctgcagggcgtttttgtatcatctactccggcaacaaacaaaaatttaccgtatcattgtgccgcttttcatttaccctggatcttatggacgtggtaaagttaatataacataaaaactaagcaaggaggaagtgtatgaagattttagctatcacggcatgtacggcagggatcgcccatacgtacattgccaaggaaaagctggaaaatgcagcaaaggaactgggggatcatattaaagtggaaacccagggctccattggggtggagaatgagctgacgccccaggaaatcaaagaagcggacgtgatcctgatttccgcagatatccgggtgaacaaagaacgttttacagggaagccggtagtggagattccgatcagcatggtaatgaaatccccaaaaggagtgatctcaaagatccacgaaaagatggggaagtagctgaagcgaaacaaagcaaagaatatggaaaaagaggggaatacaatggcaaagcaaaaacttgatattaaaaaacatgttatgacgggaatttcctatatgattcccattgttgtatgcggaggtattttaagcgcactggcaaaagggtttggcggatatgatatcggaagcgccatagaagcaggggcaacgccgttttccaatttaaatcccttttcctggattggcttttggtggggcatcaataagctgggatctatcgcaatggattttgcggtggcggtgatgacggcaggagtggcctattccattgcaggccggcccggaatcgtgcccggcattgtgatcggttactgctcgtcccaatccaaggcgggatttctcggcggacttttgatggcctttattatcggctcctttgtaaactggatgaagacctggaagcttcccaagtggtgtgtaggattgatgcccgttatgttcatacccgtggtatcgactcttgtatgcggaatgattttcctatgtgtgttctcgatccctttggcatttatcatgaacgtgttccagcagtggatcatttctttaaacggaggagcaagggctgtaatcggaggagtaatcggtgcctgtatgggatttgatatgggcggccctattaacaaaacggcctccatggcggccaatgccctgggagctgatggaatcaatggtcctatggctgcaaagatcatcggaggtatgactcctcccatcggaatttttattgctacattgttaaagaagaacaagttttcaaaagtggagctggaaactgctaaaacagcgcttcccatgggcctttgcttcattacggaaggtgtccttccctttgcggcagctgaccctgcaagagtgatccccagcagtatgatcggttctgctgtggccggagccattgcggtaggcgtgggctgtgaatccgtggcaggacatggaggtatcttcgtggttcccatgatgaaaaatcccctgtggtttttaattgccctggtcatcggctctgcggtaacaggagttatctatgcagtccttaaacggcctttggaccagcaggtggaaaaggaagaggaagaatttgacattgatctggatattaatatccagtaagactgcggacaatatggaatgccccggaaaacatgggcaaaagtatggaacgccctgcgggcatcccttgatgcccggaaaacatgggcaaaagtatggaaaggacgagaaaaacatgttagtatcaatgaaagccatcctagatgatgcaaataaaaattactacggggttatggccatgaacagcatcaacattgagatggccagagcaggaattatggcggcggaagaggagcattctcccatcatcgtgcagtttggaccggggcagatgaaaaaccatgcccatgcggaagaaatgcttcccgtgataagggagctggcatccagagttcatgtgcctgtcgccttaaatcttgaccatggatctgatttttacaccattacggactgcatcaaccggggctttacaaatgtcatgtacgacggttcctcactgccttacgaggaaaatgtaaagcgcacggcaatcatcaccgctcttgcccatggcatgggctgttccgtggaaggggagctgggccatgtgggccaggcagaccatgaggatgactcggatacggatttgtatacagatcctgagcttgccctggattttgtagaaaaaacaggcatcgatgccctggctgtggcaatcggtacggctcacggagcctatccgaaaggaaagatcccgaaactggattttgaacgcctccatcagctgaaggaaactttaaatatgccgttggtgcttcacggcggctccggttcaggggaagagaatttaaagaaggcggtggccggggcatcaacaagatcaacgtgtgcaccgatgcctttgaggcaggcaaaacagccatgttaaaagagcttgaagagaaaccggggacggattatatgcatctttgcatggctgcggaagccgggatcaagcagtttgttagagactacatgaaggtgatcggttccagcggcagatacatatatggagaggcaaagcaggcaggaaatgaataattcctgaaggataggggtgtttacttgaaggaagataagaacgcattatataataacaaaatattgcagtgcctgataaacggagagacttataccatactgcagcttgccgataatgtgggactatctgaaaaaacggtgaggacccgtattaaacagcttgaggaatggctggaggcggaagggcttgggaaaatagaaaagaggccggggacagggatatggctggagcttgacggcaggcagagaaagcttctggaagaccgtctggaacagggggaagaccctgccggggatttggagaaccggaacaaacagcttatgggaaagctcctcaaaatgaagccgggagaggtcctgaccctgcagcagctggcagacagcctctatttaagccctcccaccgtcagcaatctgctgaaaaacgtatcggactggtttgagaaacggaatataaagataacagccgtaagaaacaaaggggtatgtctcattgggaaagagtacagcttccggatcgcgattaaggattatatgctggaaatgcttccggaagtcatggaggcgctgtatggcacctatgcgccgggagtggatgcggcccgtatccggcgcatgatcgtggaggcggaaaacgcctggaggatcgagctggccgaccattcctttaagatggtctggatcatggcatgcctgtctgttgccagaaggggcctgggcgacgggctcctttccagcagcatgcaggaggaaaatatccagcgttacaatgaatattcctttgctgagtccatttaccagaggatcggtaaggaataccaggtggacttgtcagaggatgacaccatccttttggcagtgctgctgctttccgccaaaaagctgaaaagttttacggatgtcagcgatgaggattatgccatgcagtatgacaggaatctggaacgctttgtaaagctggtgatcgagaccattgattctgtgctggatgcagacctttccggggacaagatgctgtatgaaggcctgctgatccatatgaggtcggccatattccggatgaagtattccacagtgacaggagacaacataagcaaatatgtgaaaagtgaatacaagcagacctttttggcagcctggtctaccagcagcttatttgaggagtattatgacgtgcaggtgacagaggatgagcttgccgggatcgctctttatatccaggccgccataatccgcaggaaaaaggggagacctctgacagctttgctggtgagtcagagaggcatggcggcctgtcagctttccattgaaatgatcaagtaccgcattcctgagatcaccgatgtacaggcagtcagccgtcatgattttaaattgtccttacacccggaaactgatatcattatcgatggttccggactggatttacaggattccagggtggttacagtgggagaccgcataagtgaaaaggagatcgaggtcatacgccggaaggcggcccaggtttccaggctgagaagcaggccggatttccagttcagcagcttatgccaccagttgtttgaggttgacttgatcatgattaagcctcaggtgaaggataaagaccagctgatcaccatgatggtgaagaggctggaagataagggagatgtgactcagaattatctggaaagcgtgtttgacagggaaagagccaccaccacaagcataggcagggggatcgccattcctcatggaaacatggcggaggtgaacgaatcccgcattgtggtggctattttagataaaccggtcaagtggcatgaggatatggtggacaccatatttctgcttgctataaaaatgacatcaaaatttgagataaaacggacaaagcagttttataaagattttctgctgcttacagagaatgacgacaacatggaggcaatgaaacggctggaatcatctctggaggtctatcagtattttatcaagtaaggggagaaacaagatggcagtaaaagagattctggataagagggtcattgatttagaaatgaaggcatgtaataaggatgaggtaatccgccatctggcaggactccttaaaaaagcaggatatgtagaggacctggaaggttatattaaggatgtgtatttaagagaagaagaaggaatcactggaatcgggggacatgtggccatcccccacggcaaatcggattttgtggataaagtaggaattgccgtgggaagaacagagcagatggtggaatgggagtcctatgacgaggaacctgtggacctttttttcctgtttgccgtgccttctgacagcggcggggcaaaggatcatctgcgcctgatcgcagagctggcaggcaagcttggaaatgaggccatcatgagaaagctgcaggctgcgtccacgtatgatgatttactggatgcgttttcataaagaaaggcaaggaggtttgaccatggaaatgcgagagatagggaaatcaggaatcaggaccaatgcctttgcactgggctgctgggcaatcggcgggggagaatggtggggagccaatgacgatgagatgtcggtgaaaaccattttaagaggcctggagcttgggatcaactggatcgatactgccagggtctatgggtttgggcacagtgaggaagtgatcgggcaggcgttaaagcagacggaccgcagccgagtcatcctttccaccaaatgcggcctccagtggtatgacgatggaggggaagtgcatttcacaaaagaaggccataccatttccagagacttatcccccagggccattcggagagatttggaactgagcttaaaaactctgggaaccgactacattgatgtatactacactcactggcagtgcaagacctatggcatagtccctgtgacagagaccatgggagagcttttaaagatgaaggaagaaggaaagatccgtgccattggtgcttccaatgtggatctgaccgttcttaaggattatgtggcggctggacagctggatgtcattcaggaaaaactcagcatcctggaccggaaagctgaaacaggcttccttcctttttgtgaggaaaacgggatcaccctccagacctattcccccattgaacagggacttctggcagggaaagtcccggatgattatataccgaaaaagggtgaggtacgggacggaaagacgtggtggaagccggagaacatcaggacggcaaatgagatgctggcaggctggaaggatttgactgataagtaccaatgcagtcttgcaaatctctgcatcagatggaactccatggtatcccccaatattaatgtgctctgcggcgcaaggaagctgtcccagatcgaggatacggcaaaatccatggacattcctctgtcccaggaagattttttacggatgagagaagatgctgacaaagccatagagaaacaggtttagacaaagaaaacagacggaaaggaatggagcaaatgaaaatcgcattattaaatgaattcagtcaggcgcctaaaaacgaaatcatattaaaggagttaaaaaccgtgacagagcctatgggccatcaggtctataacgcggccatggaaaaacccttatcagaccaggatgtgcccgaggcatatacaaaggagaacccaaggctcacctatttgcacttaggcattcaggctgctcttcttttaaactctggggcagttgattttgtggttaccggctgcggcaccgggcagggggctttgatgtccttaaatatgtatccaggggttgtgtgcggctattgtatagagcctacggatgcctatctgtttttacagatcaacaacggcaatgccctgtcccttccctatgccaagggctttggctggggtgcggatttaaacttaaacaatatttttaccaaggcgtttggctcgccaaagggtatgggatacccggagggcagaaaagaggctcagaacaggaatgccaaccttctttttgaggtgaaaaagcaggtggcaaagccgcttctggaggcattaaaggctttggatccccagctggtaagggaatgtatgatcccaagattcctggactgcttttatgaaggatgtaaggatgcggaaatcaaggcgtttgtggatcaggtggctgcaggagaaaagtaattctccgaaagatacagggtgtcttttcttagaaacatgtacctaaagggtttgctgtgttactgaatgggctgactctgttttcttaccctcctttttgtattataatttttacaaaaaggagggctgcatatgaataaaaaaattaaaattgtaaccattggaggaggttccagctacactcccgaattaatggaaggattcattaagaggaaagatcaccttcccattaaagaaatctggctggtggatattgaggcaggaaaagaaaagcttgagattgtcggaaatctggcaaagcgtatggtggaggcagcaggccttgattgggaaatccatttgacattagacaggcgtgaggctctaaaagatgctgattttgttaccactcagttccgtgtaggtctgttggatgcgcgcattaaagatgagagaattccgttgtctcatggaattctgggccaggaaaccaatggcgccggaggcatgttcaaggcattccgcaccattccggtcattttagatattgtagatgatatgaaagagctgtgtcccaatgcatggcttgttaattttacaaatccttccggcatggtaacagaagctgttatgcgttatggcaattgggacaaggtggtaggtttatgtaatgttcctattctttgcagaaagattgcagcaggagctttaagagaaaacgaggaggatttatttttccgatttggcggtctgaatcattttcactggcacagggtatgggacaaaaccggcgaggaaaagaccggcgaggtacttgaaaaggcttacaccagcgttgagaatatgaaaaacgcactgaaaagctttaccagcgcaaattcgggagtacagaatattccaaacatctcatttttaccggaacagatttgtaatcttggaattattccctgcatgtaccatcggtattattatattacagatgatatgctgaaggaagaattggaagcctatgcaaaaggagagacccgtgccgaactggtaaaacgtaccgaagccgaattgtttgaattgtataaagatcccaatctgagcatcaaaccgcctcagttagaaaaacggggcggagcgttctattctgacgcggcctgtgagttgattaattccatttacaatgacaagcgcacccatatggtggtcagcaccagaaataatggagctatttcggatctgcccgatgatgtagtggtggaagtgagcagtatcattacttcaggcggtccggttccgatttcctggggttcctttgagccttccagcagaggtttgctgcagttaatgaaagacatggaactgacaaccattaaagccgcggtaaccggtgattacggtatggctcagcaggcatttaccataaatcctctggttcccagcggtaaaattgcaaagacagtgttggatgaattgctgatcgcccataaggagcatttaccgcagtttaaagatatcattgatcgtctggaagctgagaacagttaagtatctgtttatttctactgcttcctgttataaaaggagtcattgcacgctgataggaacgttggctgcaatgactccttttgatggatatggaattcctgttcattgaaaatacagtccttttatgttaaaatgaaaaaaacaccctgtaacttttatcaatgaatacaaaaggcggtagcagattatgatgatgttttctaatcaggtattaaaccagtttagtgaacttgattatgaggtttataatttcatattaaagaacagtgagaagattccttatatgaccattcgggagtttgccaatgaggcccatgtttccaccacgaccattacccggttctgcaggaaagtaaactgcaatggcttttccgagtttaagatccggtttaaaatggagcaggagagcacaaagaaggtccggcagggatttgatttcagttccatttcagactttttccaaagaatcgggacggaatcctttcatgaacagcttaaatttgttgccgatattatagcagaaaaaaagcagattatttttctcggaataggcaattcaggaatcattgccgagtatgcaggcaggtatttctgcaatatgggcatatttgccacaggaatcaataatcctatgtttcccattaatctggaatttccaaaagaaagcattattattattctttctgtggagggggaaacagacattctcattgagaattcagagattattaagcaatgcaacagtacggtcgtatccattaccaacagtaaaaacagcacattggccagaatttctgatcacaatatatcttattatatccagtgggaacggacggactataagaagatgaaggtggatataacctcccagataccggcagtttatattgtagaggctttggctaagctgacggtgcagagaaaacagggatgaaaagagagtcaggcattaagatatgtagttgaagacgagacatataagaagataattaaatcaataaaacagcccttcggaatggagtggaaaatcgtaccctgcagttgaagcacagaaaaagaagctgtgttttgcctgcagggtattttcatgtatgggatctgcaattatatccctgtgagaaaacttcccaattcattagagaagttttccatatggagtttcaattacccggatgataggatgaagacaggagagggttgccatgaatacaaggttgatgaatttgtttattccttggactattgcattgtcagatatttaacaaagctttgagataatataccgcttagacagcagtaaagaaatgacttttgcatacagatatgataaaatgtttttaagattaattcaatcaataaaaattcatatgagggaggaaaagactgatgaagatagaaataagagaattctgcgataaagatatcactcaatcaatagaaatatggaatgatatcgttgagcagggaattgcgtttcctcaaacagagattttaaaccaagagacaggaaaagaatttttcagacaacaatcttttacaggtgcagcctttgatgacagcaatcatatcgtggggttatatatcttacaccctaataatattggacgatgcggtcatatctgcaatgcaagttatgctgtcaaaagcagtatgagagggcatcgcatcggtgagcgtctggtatgccattccatggacaaaggaaaagatttaggatttaaaattttacaattcaatgcagtagtgagcagcaatgtctctgctttggctttatataaaaagttgggctttacgcaattaggagtaattccaaaggggtttcagatgaaaaacggagaatttgaagatattattccccattatataactttataaattctttttggcatacataataatattgaaggtatcaatggtccgccaaggttatttacaggaaatgcaaaggggtgcagggagggacgatgaaaacatttgattatggagtaaaggaacagtttgggatccatgcaagaccggcagtaatgctggcaatggagagccaaaagtatgactctaagattattatttctcttaatgggaaaactgctgacgcttccgatgtggtggcaattatgggactgaacatcaaattcggtgatatcataagggtggagattaccggcaaagacgaagacatggcatatgaccggttgaaggattttttctttcatagcctttctctttgatccggtaaaaaaatgcgaaatcaaaagaaaagatttgcataatccaaaagggtatgctataatccaaatatcaagacttgttaccatatttcgtaaatgaaaaattgggcaaaatctttctggaagaaggattttgcctttttttattgcgtttggagggaattatgggctgttggaaaattgtaaaaatacttaataataatgttgtgtttgtggtggacaacaaaacgcaggagtacattgctgtggggaatgggatcgggttccgccataaggtccgtgaatgcctatccgacgatgaaatcataaagatttttgctcagataaataatcaggtgaaaaataagctggtaaccatattggaggagatcccttttgacaggatcgagcttaccatgaaattggtggagcatgcggaaatatctcttgaccgtaaattaaatgaaaatttggcggtcagtctggccgaccacatccattatcttctggtaaggtatgaagaaggcatgctgtttcccagcatagcaagcgaagaaatcaaaaggttttaccaggaggaatataagattggccgtgaattggtggatatgatcaatgaaaaatataagattcaactggattatgaggaagccagcaccatcgcatttcatatcatcaacgcaagcaatcagagaggccaaaagactcttgaaatcatgtatggggtgagggatctggcaaatattgttacggaaagcctccacattgaaccggatgaggagtccttcgattactcccggttcatcattcatttgaagttcttcatgagaaaggtgcttttaaattcccaggagctaagccatgaaaacaattccatgcttcaaaggtttgaggtggagtttccggcgatccacgaaatcgttcaaaatattgaaatgtacattctgaataaatataaatatcaaatgggtgatgacgataagctttatttattcatccatatccggagattattgaaaaaataaaagggataaggaatcgtatgtgcgcagtacggtttacattataaataatatttaggaggaaacttatggcagtgaatgtgaaagaattatcagattctattatgaagcttataggtgaaaaggataatgttcatagtgtgacccattgtgttacaaggcttcggtttattttaaaggatgtggaaaaggcagataccgaggaaattaaaaaaattgatggggtcctggggtagtatttggttccggacaatatcagattgttttaggccctaatttatttccggtatttgaatatgtagtaaaagaatatggactggaaacggacgatgaggtagaagagtaccataaggaagatgtggcacccggaaaaacatcaggctttggctattatctgggaaaggtcattcagtttttatcagccacattaacaccctttattacggtgctgtacggagccggtatgctgaaggttgcgttgggcttaagtgcatacttctggcctgatgtgactggaaataccacatatatgatgtttaattttatgtccaatgtgccgttttactttatgccggtctttatcgcctacggtgcttcccgtacccttaagtctaacccggcctttgccatggccatggcattgatgctgctttaccctaattttgtccagttgatcggcggggatcaggcggtgaccatctttggcctacccgttaccctggtaagctattccaatactctgcttccggcaattttatctgcgctgctggccgcccgtttggaaaaattcttctataaagtgatacctggggttttgcggtccgtatttgctcctctttttaccctggcggctgcaatgcccattgttatggttgttctggctcctcttggaaccattgcaggtaattatattgtaagtatttttgtagggatttacgatgtgacaggaggtgttgccatcgggttattggcagcagtatggccgtttatcgttatgggcggcatgaatatgctgtttgtagcgcctatgaccgagctgctggctaataccggttacgataacttcttcaggcctgcatggatcttacataatattgcagaaggcggtgcctgcacgggagtcgccatccgcacaaagaataagaagctccgctcggaagcaatttcagcggcaattggcgctattgtttcaggcgtttccgaaccggcaatttacggaatcaacttaaggcttaaaaagcccctttatgcagtggttgccggcgggcttgcaggtggagctgcggcaggaattatgggagcaaaagcgtataccttaggctattccagtattttggccattccgatttttatggacaccatgctggcgatcatcattgccattggagtgacgtttgcggtgtctgttgcggcaactgtagtcatgggatttgatgattcagcgattgcgcagtaggtgaccagaatatgagtattttcagcaaatggtttggtacacaggaaaaacaggaacataccatggtggcctttgccactggaaccatgtgttatttatctgaaacccctgatgaggcattttccagcctgtctatgggaaatggggtcgctattacccctgaccgcccatccatcgttgccccggtggatggggagatcaccatgatatttcctacaaaacatgcatttggactggtcacagaggatgggatcgaattgcttgtccatatgggaatagatactgtgaatttaaagggcaagggatataagtatttcaaggaagtaaatacaaaggtcagggccggtgaaaaaattgttgatgtggacattgatgtcattgaaaaaagcggctgtaatcccattgtcatgatgatcgtggtcaatgagaacggatatgacttcacttatgaagcaaatggcagtgtaaaaaaaggaaaatcagtgattggaagatatgagatcaaagaaacgatgcaatgaaatttgaagaggaggaaacgattttgaaaaaaccggaaacaggattcaaagacggctttttatggggaggcgcagtggctgccaatcagttggaaggagcttatctggaagacggaaaacaaatgtccacagctgatattaaggaccgcggtttctttggaggcatccgccgtgatgcagattattacccaacccataaggggattgatttttatcatacctataaggaggatttaaaattaatggctgatgccaattttaatattttccgtacctccatcaactggacacggatttaccccacaggagaagaggagacgcccaatgaggctggcatcaaattctaccgcagcatgtttgaagagtgccgcaggctgggaatgaaggtgatgatcaccatttcccactatgagacacctttggcaatgcgggataaatatggaagctgggctaaccgggtgtacatagatttatacatgaaattcgtcagaaccattgttactgagttcaagggcctggtcagttactggctgacctttaatgaaatagggaatgcggcggtaaagcccatttgctgggatgctgcagccatttacccggactctgatcaactgcttcaggaaatgtatcaggcggcgcaccatcagtttgtggcaagcgccctggctacaaaattcatacatgagacagataccaatgccttggtcggcgccatgatcgcatataaaacagtgtatccttatacctgcaatccggccgatgtgatcgctgcggaggaagaaaaacgcaaggaattcttcttctcagatgtccaggcaagggggtattacccaagctatatctggaagttctttgaggaaaacaacctgaatattgtaatggaggaaggggacgaggatattatcaaatcttatcccattgatttcatttcattcagctattaccgttcccgggtgatttcggcggaatccatggagcctgcggaggtgatcaataccaattccctggaaggggtggtcaatccctatctgcggaaaaccggctggggctggtctgttgacccggatggcctgcggcttgctttgcaggagttatatgacaggtatcagctgcccttatttgtggcggaaaacgggctgggggctatcgatgaagtggatgaagacggatccataacggatgattaccggatcgattacctggaaaagcatatgaaggcaatgaaaacagccattcagcacggagtggacttgtttggatataccatgtggggccccatcgacattgtgagcaacggtacgggccagatgtccaagcgttacggaatcatctacgtggatttggatgatgacgggaacggcacaggaaaacgcataaagaaaaaatcttatcatttttacagcaatgtcataaagaccaacggaaaagagctgtaaagcaggaggataaaatgaaaaccaagggatcttcccaacagaaaacggttgatgaatcagaggatggcattgctgaggatgattaccgtctcgaatttttaaaagcttatgtgtcagccatgaaaaaagacataagaaatgattcagattcgtttggatacacttgcaggggaccgatccatattgtaagtgaatgaaacagacaaaggtaagagatgtggattcaattatacaagtttaaccgaatcaagcgacagctgctattcggttatgcccgataaagcggggcacgccctgagcatgtagcgaagcggattgcgaatatccgattgagtttttaataagcttagagaaaaaccatgtgagtaaccgaagataaatgcggctgcttccatggtttttctgcgtaagtgccgttaagatatgatttttctgatatacttaatggatgggatggaatatttataaaatttgcacgcggtgagtgcaaatatatatttgtaatggattttaactgccattataataattccaggcctgataagggaaaagaatttggaaacttactgaaaaggcttaccatttacaaggagcgagggagaaatcatatgaaagaatttgaatatgtcataaaagaaaccgtaggcattcatgcaaggcctgcaagccttttagtcaaggaagcatccggctttaaaagcacggttttgatttacaggaacgaggacagggcagatgctaaaaagctgttgtccattatgtcattaggggtgaagtgctcggaaaaagtgagattcgtcgttgaggggaagatgaagaagcggcggcagataagcttcaagaattttgccggcaaagtctataacagaggaaaataggttgcagtgttcttaaacggggtgatcatatgcagagcaagcagatagaactgattaactatatgatggaaaacaaggccagggtattgacatcccagcagttagccgatgttttaaacatttccatgcgttccgtaaagacttatatttcccagataaatgaaacaggaaaagggaaagccattatttccaacaaaaacggatacaccttaaatgttccggtggcaaaaagcctgctggcccaggagaatatcgtcatccctcagacatatgaagaaaggtccacctatgtgatcaaagcttttttccttcagcataccaacagtctggatctttatcacatggcggatgaattatacgtcagtgactccacgctgaaggctgatattaaaaagatgaacatgcggtttaaaagctttaatattgtgtttgcaattgagagagatcagatcaagcttcaagggccggaaaaaaatatcaggaagctgttcagctacattctttatgaagaagtggataaccactacgtggatttacagattttaaaaagtaattttaagaacattgatattgattccatgcttccagccataaaacagatattttcaaagaacgattattacatcaatgatctggccctgaggaatatgctgcttcacctggtcatcatcatagagaggatccaggaagggaagaccattccctcaatggtaagggagatccaggatcaggattcggaaaatgagtgcgttgcagaactgtgtaaaaagctggagcagcagttctccattaccattaatgaagaagaaaggcgtgaaatctacgttttattcaaatccagcacaaattttgttgttaccgggggcatgcctgaggtacgggcccttgtgggaaatgagattatggaggaaacaaaggagctggtctatttaatccagcaggcttatgccgttaatctggatacggaaaacttcatcattccctttgccctccacttaaaaaaccttatgctgagagcaaaaaacagtaccaacataaaaaatcccatgctggaatccatccagtcccagcacttgatattgtttgatatggctttatacgtatccttacagctggaaaaaaagcataaaatatacatcagccaggatgaagtggcatttatagctctgcacataggaggcgagatagaaaggcagaaaaataacaatccaaaggtacgggtggttctgctttgcccaagctatatgaacatagaatccaggctgtacaatgagcttttgatcaatttcagcaatgacatcaacatcgttgcatcggtgagggattcccaccagctggaagaattgaattatgacctgctcatttccactgtaaggataaaagtgcctgcggcctgtgaaaccgccgtcatatctccgtttatgacctcaggggacaagctggaaatacaggaaaaaatagaaaattctctgaataataagaaaaacaagatgctgacaaggcattttaacgattactttgaaaaggaattgttttttgtatccaataggccattggacaaaatggaggtaatcgatatattggtgggtaatttatacgaaaaggaatacgtgcggagagattacagggaacatgtgctgatgagggaaagagctgcctgcaccgcatttggaaagatcgccattcctcattccgttgagatgaatgcctataagacctgtgcttccgtaatgatttccggcaaaggcatacggtgggaaaaccagattgtatatgtagtcttaatgatcgctattaataaactggataatcatgtatttaaggaattatatgagtcattagttataattttttctgaggaaaccaatatcgagctgtttcgggagtgtagatcctatgaggaatttgaaagcacattaaaatcgatcatcggctgagaaggggagagaaaaatcagtgacggattgcatggcagggtgcaaaacgtaatttgatttttctcttttttttaatcataattattcttgtaagtgagatgcagaggggttcacattttgcaggaagaaaggaggaagaaacaatgggcgacctaaggattatattgtgctgcggtgccggcatgtcaagcggttttcttgccaacgcagtaaagaaagccagcaaaaagaggaaaatgaatgttacggtagctgcccatgcggaaagcaatgtaatgtccgtagtaaaggaaggggcagacattctttgcattgggccgcattacggatcaaggtatgatacgtataaggaattatgttcggaatatggaacggaagtcatggtgatcccaaaggatatttatgggaccctggacggtgaagggttgttggattacatcatcgggtatcttaaaaagtaatgacaagaataggagaaggaagtatgaaaaaatttatgaagtggctgattgattcctttgcgccggcaatgaacaaattggtggaaaacccgtgggtggcagccgtatcccaggcaatgatgagggtgcttccatttatactggtggggtcgctggtgtttttctacaatgtatttaaggattatatccccggccttccggatatatttcccattgccagctattcctttatgttcatagggatcttcatttcttttttgatcccctataatctgatggagctgaagaaaaggaataaattccaggttccggcaggcctgctgggcttttccgcctttattatgtgcttaaagccgacctttgatgaaaattcctttatgaacgtgaatttcggggtgtttggtcccagcgggatcatggtggcaattgtaataggactttttgttgcatttgtatttaatttatggacgcggtttggtttcctggaagacagtacgaccattccaagctttttggcaaactggatcaacagcatcattcctattttccttatcctgctggtgatcatgatcgtggtggagggtggcggagtggatattgtatccgctgtcaatgcggtatttaagcccattgcttcctttggacagtcttatccgggcatgatctttatgtgtctcactcctgcgatcttatattcctgcggagtttcgtcatgggcattcggcgccatatccactccagtttttatggcaggcatcaacgccaacattgccgcgattgctgccggagggattgcaaccaatatcgtcaccagcgaaacagtttttactgccgcactggttaccatgggcggaatgggagccaccctgcccctggtggtgcagatgctgcgttccaaatcaaaaaagatgaggaccctgggaaaggtttgcattgcccccagcattttcaatatcaatgagccggtgatatacggcacgcccattgcatttaatcctctgctgatgctgcccatgtggatcaattcttttacaggcccaacaatcatttatgctgccatgaagtttggctggctgaatattccgggaaagatgattcaggtaggccaggttccggctcctgtttccactgtgatgatcactcaggatttcagggcaattatattttatgtgattttgtttgctgtatattatattacctggatgccgttttttaaggcatatgaagggcagtgcataaaggaagaagtgaatatctaggaaggaagtatttatatttatggaagatattatggaaaatgagctggtaggagttgccatgcagatcattttacatgcaggcgatgccagaacggctgtagaacgtgcgcttgactgcatcaaggaagaaaattttacggaagcaaaagagaagatggtggaagcaagagagtgtatccgattggcacatgtatcccagacagaggtgatacaaaatgagacgaggggaaaaacatatcagccatgccttctttttgctcatgcccaggatacgctgatgaccatcaattccgaggttttgctgtcggaaaagctgattgatttgtttgaagtggtattaaaaaagattcatacagactgtttaggagtaggagatcattatgcttaaaaagggttttccggatgactttctttggggcgcttccacctccgcctaccaggtggagggagccgcgctatcccatggaaaaaaggcatcccagcaggatatcatcaataaagataattatgaaaaaagaggctttgcaactgcggagatcgcaagcgaccattatcatcattttaaagaagacgttgcattaatgaaggagatgggatttacggcttaccgtttttccattgcctggagcagggtgtttcctgacggcacaggagaagtaaatgaagaagggatacagttttacagggatttaatcgatgaattgctgattcacggcatcgagcctattgtgaccctttatcattatgacctgccctgggcccttgttgaaaagtatcatggctggctgagcagggaagtggttaaggattttgagtattatgcggcctatattatcgaagaatttaaggacaaagtaaaatactggacaacgattaacgagcaaagcattatcgtccagttttggacccagaaatgttttattcccagggaactgcagtctaaccatcagctgagataccagatcaatcatcacatgaatctggctcatgctattgcctgcaggctggttcacgaaaaggtgccgggagggctggtgggagcggctatcggttatgcgcctgtttatcccctgaccagcaagccggaggatgtgatggccgcccagaacgctcacgatttacataacggatattatcttgacatttactttaaagggatttatacagaatccgccatgatctatcttgaatcaaagggacttgcccctgacatagagcctggggacatggaactgatcaaggaagggtattccgatttcctggccctgaattactattccagtgagtgcgccaaggcgtgccttaaggaggaagaacttcggtttgcaggggtaaactggaccggcgtaaagggagccatggacggtcatgaacaccagccgggatttttccagatgtgccccaatcccatgctggacaccacggactgggattgggcaattgatcccacaggcctggaatatttgctgcgggacatttccatgcgttacaataagcccttgatgatcactgaaaacggcctgggagcttacgatactctcacagaggatggcaaggtccatgattcttacaggatcaactacttaagagaccacgtgagatctataaaaaaatccatggattttggcgctaaagttctggcttactgcccatggtctgccattgatctgttatccaccagcaacggcgtgaagaaacggtacggatttgtgtacgttgaccgtaccgacgatgatccaaaggaatgtacaaggatcaggaaggattcctttttctggtataaaaagctgattgaatcaaagggagaagaccttgaatgattcccaatgtctgataaaggaggcgcttatggaaaagacaaaaaacacctttcccaatgattttttatggggcggtgcggtagcggcgtgccaggtggaaggggcctatgatgtggatgggagaggcttatccacttccgatgtccacatgtactcaaagaacttagaccgttccaacgtgtcaaaagaagggggcgggacccgcagtgaaatactcggctatatggaggatgataaaaactattacccaaaacggtatggaatagatttttaccatacctacaaggaagacctggcattgctggcagaaatggggtttggcactttccggacctccatatcctggtcacgtatttttccaaagggagatgaaaaagaacctaatgaagagggcctggccttttatgaccggttgatccatgagatccggaaaaacgggatggagcccatcatcaccatttctcattatgacatgccccttcaccttgtcctggaatacggaggatttgtgaaccgggagctgatcggctttttcgtccggtatgcgtccgcagtcctggacagatttaaggataaagtgaaatactggatcgtttttaaccagatcaatctgctgcaatactgctcctggggctctatcgggctgttggatgattatgccggggatttggaggaggccaagtttcaggccgtgcatcatcagtttgtggcaaatgcccttgtatacgaatacggaaagaaattaaatcctgacatgcagatcggaaccatggtggcagactgcacctgttatcccaattcctgtaagccggaggatgtggttctgaccatgaaacgcaaccggatgcagtatttttatacggatgtacagcttcgggggaatatccggcttatgcggtccgtttctttgaagaaaacggctggaacatcaagacggaggcaggagatgaagaagtgatcagaaagaacaggcaggactttctggcgatctcttattactcatcaaaggtcattgacggggactgctgcggaatgaatccaagggatgtgatacaaaatcccaacctaaagcctacgccctgggagtggcggatggatcccctgggattttataactgcctgtcccagtattgggacagataccaggtacccatgatgatagctgagaatggcttcggggccattgatacgttggaggaaaacggagaaatacatgatgattaccggattgattactaccggaagcacatatcgcagatgaaggaatgcatcagggatggggccgatatttttgcctactgtgcatgggggcccattgatcttgtaagctcctcaacagcggaaatgagcaagcggtatggatttatttacgttgaccaggatgacgaaggaaggggatcaaaggccagaagcagaaaggattcattttactggtacaaaaaggtaattgcttccaatggggaagatttagattaaggataatttcatggaatgccggtggaatgctcttgaaaaagagagcattttcaccggtatttttgtgctgctcccatagttttcggccgcagggtaatactggatgattctccagcaatgagttaaatcttaacgaaaaaataattgacacaccatttaaacggatgtagaatgataaacattgaaaattattaacaatgttaagtaaggaaaaacagggggttttattgtgaaggatggacaggaagaatacataaaaaagtttaaatcggaattagccatgatgatgggaagtaagcaaaggatccatagaaattgtatgacggaaggaatcacccagagtgaattttttgccctgcatcaaatacggactgccatgaatgaaaacccggaaagcagggtattcatgtatctgccctggcaaaaaggctgaatatcgcattatcggcagcatcccggatgctgaatacactggaagaaaggggcctggtatacagggaaatagatcccaaaagccgcaggaacatctgcgttttcttgacagaagaaggggagaacatgtggaagaaatgctctgaaacgatgagcgggcttttggaacgggtaatcattgccatgggagaagaagacgcatgcaaattaattgaattgtggaaaaagttttcgcaactgatggaaaaagaagtgaatttaatggtgaaggaaaaggaaacaagtgaggaaaaacgccaatagattgggacagttaacaacgggttttaaaaagcacataagagatgaaaggaaaggagggaatcggtttgaagatattttttcagtattttaagccctaccttttgtttatagccatgtcagtggctctgctgtttggtcaggcaacatgtgatttgtcacttcctgacttcatgtctgatatcgtaaacaagggaattacaacgggcaacacctcctatatcattaaaattggatttcaaatgttgggaatcgcttttatcagtgcctgttgtacgattctggtgggccttatcgccgccagaatagccgccggcgtcagccggaatctgcgtcaggacatttttgcaaaggtagagagcttttccaatgcagagatggaaaaatactccacctcatccctgatcacaaggaccaccaacgacatcacccagatccagcagctgatcgtcatggtgatccgcatcgtattttatgctcccatcatgggagtgggaggcgtgatacacgcgctggacaaagacaaatccatgtcatggatcatcgctctttccgtgggattgctgctggtggtggttttcagcatgctggcggttgttttgcctagttttcagtttgttcaaaagctcattgaccgtttaaacctggtagtaagagagagcctggaaggaacgctggtgatcagggcatttaatacccagcggtttgaagaaaaacggtttgaaaaggtgaatacaaggctgactgagacaaatttatttgtcaaccgggttacctcgggcatgatgcctgccatgatgctgatcatgaacttaaccaacctcctgatcatatgggtggggtcaaaggcagtatcctccttccggatggaggtgggagatatgatggcttatatgcagtatgtcatgcagatcatcatggcatttttgatgatgaccatgatgttcatcatgatcccaagggccatcgtatccatcaggcgtgtggtggaagtgcttcagacagaaccctccattggggacccggaggctgaggctgagcttcccaaggagcccaaaggcgttgtggaataccggggcgtatccttccggtatccggatgcagatgaggatgtgttacataatatcacgtttacggcactgccgggacataccacagcttttatcggcgccacgggaagcgggaaaagtactctggtgaatctgcttcccaggttttatgatgtgacccaaggggagatcctcattgatgggctcaatatcaaggcctggccccttcataagctgcgggatattataggatttgttccccaaaaggggattttattttccggaaccattgaaagcaacttaatgtacggagaccggacggccggcagggaacaggtggaagaggcggcaagtacggctcaggccatggaatttatcaattcaaagccagagggctttgaaacctccattgcccagggaggaggaaacgtatcaggaggacaaaaacagaggctttccattgcaagggcacttgtaaaaagagcacctgtgaatgtgttcgatgacagcttttccgccctggactttaaaaccgatgcaaagctccgggctgctcttcatgaaaaaacaggcgacagcaccatctttttagttgcccagcgcatcagcaccattatgaatgcggaccagatcattgttttggagcacgggaagattgccggaaaaggaacgcaccgggaactgatgaaaacctgtgatgtttaccgggaaattgcattatcacagcttagtgaggaggaattgaaatgacagagaaaaaaccatccagttcccccattggcggcagaggcgggcttcagggcaagccagagaatgcaaaagattttaaagggaccatgcttcatctggcccgttacttagagccgtacaaacgctcggtatttgtggtagtcttatttgccggctgttcctccgtattttccattgcagggcctaagattttaggaaaggccaccacaaagctgtttgaaggcctgatcgcctggatgatgggaaccggattattaacggatttccgttacatacgaaaccgtctgctgcttttggtggtgctctatctggtgtctgccgtattttcttatttacagagctatattatgtcaggcatcagcatgaaggtcacctatgagctgagaaagaatatttcggagaaaatgaaccgcctcccccttaattattatgatacaaggactcacggggagattttgtcaaggatcaccaatgacgtggacacggtcagccagacgctgaaccagagcctgacgcagatcatcacttctgtgacaactctggttggaattgtcatcatgatgatatccatcagcatccggatgaccctggtggctgttctggttcttatggtttccatggttctgatcatgtttgtggtgaagaaatcccaggtatattttcagaagcagcaggaaagtctgggatacttaaacggccatattgaagaaatctacagcggccataatgttgtgcagatatttaacggagaaaaggaagccattgaaaagttccggaccatcaactataaattatacggatcggcctggaaatcccagtttttatcaggaatgatgatgcccatcatgtcctttatcagtaacttaggatatgtttttgtctgtcttttgggcggctatttaaccgtggaaaaggtgatcgagatcggagacgtccaggcctttatccaatacatgcggtcatttatgcagcccatctcccagatcgcaaacgtgtccaatacgctgcagtccacagcagcagctgcagagcgtgtattcgagtttttagatgagcaggatgaagtgccggaaagcgaagcacccatcaaactgcagtcaattcatggaaatgtggaatttaaaaatgtctgttttggctatacgccggatacattgttcattcacgatttctcctctgccataaaggccggacagatggtagccatcgtagggcccacaggagcgggcaaaacaacggtggtgaagctgcttatgagattttacgaattaaattccggacatattttgattgacggccatgacaccctggattttacaagaggggatttacgctccatgttcggcatggtgcttcaggaaacatggctgtacaatgccaccattatggataatatccggtatggaaattttgataaaacagatgaagaggtcatagaagcggcaaaagcagctcattgcgatgaattcatccgggcattgccgggaggttattacatgatgatcaacgaggaatccagcaacctatcccagggccagaagcagcttttgaccattgcaagaacgattctggctgatcccagggttttgattctggatgaagccaccagctccattgatacaagaacagaagtgctgatccaaaaggccatgggcaaattgatgcagggcagaaccagctttgtgatcgcccaccgcctttccaccatcagggatgcagacttaatcctggtaatgaaggacggcgatattatagaacagggaaatcatgtatcgctgctggaaaagaaaggattttatgcggatctgtatcacagccagtttgcagattagccaaatacccgcagaaagcagcggaatatttgactccacgggcatctgccaaagtcaggttttcttgaccttggcccgttgccttctcaagaataacagaacggagagagaaaaatatgcaggaaaacaaacatatcaatgttgaggatcaggaagtaaagacaggggcaggaaaactgaaaaagatcatagctccccttctgatcctgctggtgcttgccggatgcgtgggcggatattatgtctatgactcaagcgtatcctattttaaaacaaataacgcaaaggtgacggcaaagctgtattccgtaaaggcggtaacaaacggaaagcttttgtcttgggaggtggaaaacggcgacctggtggagcaggaccaggtgctggggcggcaggaagtccttccctatatcactgctcccatttccggaacagtggtaaaaaatgacggggcagtcaaccagacagtggccctgggatcagagcttgcgctggtagctgacaccttaaatctgtacgtcggagtgaatgtggaagaaacagatattatgaaggtccgcctgggacagcgggtggatgtgaaactggatgcatatcccggaaagacctttaaagggcaggtgaccgagattgatccagccacccagacttatttttccggaaattccagctttaacaccagcggggaatacactaaggtgactcagctgatacccattaaggtggcgatcgaaaacgaagaaaatcttccccttgtatttggcatgaatgcatcagttaaaatacatctgaaatgaatagggcttacaggaggtcagaaaagatgaaaaaaatattcacgggttttatggcagcggctatactgttgggctcgcttacaggctgcggggcagaaaatcagcagactgaggttaccgttgcggtggcgaaatcgggaaaagatctgtctaccatggtatggcagggaaccgtggaagctctcagcagtgttgatgtgatgccaaacggcagcggaaagattttagagatcccggtaaaggaaggagatcatgtaagttcaggagacgttttgttccaggtggatgaccaggatgcaaggctgcagctggagcaggcaaaggcaggctatcaggcagcggaagccgcttttaaaaatgcggaaaaagcaaaccagcagaatacaggcgtaaggccggcagagatcgcctttaacacagcaagggataatttcagccgcatgcaggtcctgtatgaaggaggcgccgtttcccaggcagagtatgaaggggcaaaggctcagatggatacggccgccgtacagcttcaggcagccaccaacgggcaggcaggtaattatgaagttacaaaggcccagctggacagcgccaaggcttccctggatatcgtacagaagaaatttgacgactgtaaggttacttcccccatatccggaatggtgacaaacgtttatgtggaaataggccagatggtttctccccagatcaagtccatgacagtcattgacgacagcggaaagaaagtgaagatccaggtggctgacatggacattgaccagctgaaaaccggaatggacatgagggtcagccttcagccattaggcgaaagctgccagggaactatttccgaaatatccgcggttaccaatgcttcaacagggatgttcacggtgaccgtgcagctggaagaggcaagcaaggtcagctatatcggcctgacagcagatttaagagtatctgataataaggaaaacagctctgtatacattccggcaaagtgtatccagtccgacgattccggagcttttgtatacaaggtttccgatggaagcgcggtcaggacagcaatcacggagggaagaaaaaagaacgcttattatgaagtttcccagggactttccgaaggggacgaagtggtgatgcagagcagcagtcctttggaggatggcaaacaggtgcatgtactgactgtaaaataggttaaatatttgtatggatcctttaaagagttgagcagagaaaagcaccgccttttgatgaatggcggtgcttttcatttataacagattcagctttctggcgggaggagaaggaggccggagatttagttcctgcatgccaggcatttccggtaattcttattggcgcgttcccagtctattacctggaaccagttttggatgtatgcatcccgttcgttgtagtgcagtaagtagtaggcatgctcccacacgtctatggtaaggaccgggcagagattttgaacaatgggggtatcctgatttgctgtggttacgattttaagcttgccgcattggtccacaaccagccatgcgtaaccggagccaaagacggacattgctttttcctcgaattccgtgtaaaaggcttctattgacccgaaatccatgaccagcgcataatagagcattccggcctggcagcgggtttcagagtttgacataccgttaaaatagaagatatggttgtaaactccgcctccgttattcctgacggacttctgaacgtctttttgcaggcagtctgcgttgcagagcagctttttcaaggaccagctttgcaggtccggacagttttttagggtcttattgaggttatctacataggcctgtaagtgcctgtcatgatgaaggcacatggtctttgtgtcgatgcacggctctaacgcatcataatcataaggtaggggtggatttacaaatggataatgctcattcattaggtgattccctgtttttattatctgtataagtatattcagaaaatgagggcatgtgagggataaaggcggatttatgatttttttattcagagtttgtctgaaaattgagagacttgcatatgctgcatccagaggtttgaagacaaaatacattggaattaggcttctattatcacggattttcttgactcaactccctgggtttcataaaaagcatcatgatatttgaagcaaaaagtgaaaaagggctgtttccggcatcaatggcgggaaaaagtccttgaagattgaaaagtttagaaaattataagaattttatacttaaaaaagttatatcagcccgttataataaggaaaaaagaagtgtcaccgatacaggagggaaaagggcatgaacggatttaagaacaatgagatggaagcgggcgaaggggcggaaatggagccaatgtctgatgaagtatttgatagagagctgcaaagcctgatggaagaggaaaaaggcggaaaaaagaaaaagaagggcccgcggaaaaagtggagcaaaaagagaaagatcataaccattggagcggcggtcattggggccttttttattgccttcaaggtgatggcaggcggcgggagtgtggctatgccggtaactgcttcgccccttgcaaagggagaggtagtggaaatgctgtcagtcagcgggcctgtccagggaaccgacagcgtggaagtagtatccaatcttcatgcggagatcctggagcttctggtaaaggaaggagaccgggtagaaaaaggacaggtcttggcgacccttgacgataaggatgcaaaaaaggaagtggatatcgctcaaaacgcctatgacctggctgtgagcacctatggggataagcagagggaagcggaaaacggatatgcaaaggcaaagcaggattatgacactgccagggccaactataaccggaccctggctctttaccagggaggaagcgcttcccaggtggagcttgagactgcatccaacaccatgaatgacgcgcagcgggaaatgagtacatataccttaaaaaatggaaagccggtggcaaatgaatcctatgcccttcagatcgaaaaagaggcctttgaactggaacagaagaaggaagcattaaataatacgaaggtcaccagccccattgtggggactgtagtaagagtcaactgcaaggtgggccgttttgcagataaaaccgatgatgacaaacccatgttcatcatcaacaatttggatgtgctggaaatgaagatcaatgtcagcgagtattccataggaaaggttgccataggacagccggtggaaatcagtgcggatattttaaacggtgagaccgcaagaggagaggtgaccgccatttctcccacaggagaggagaagggaaatggttccacggaacgggtcattcccaccaccatacggatcattgaccagaatacaaagctgatcgcaggcattaccgccaaggcaaaaattgagcttcaaaaggcggagaatgtatgggttgttccaatttcagcagtgatccagcagcctgacggcagcacggccattgcctgtgtaaaggataaaacagtaacctttattcctgtgaaaaccggagtggagagcgatatccaggcagagatcattccggaagaagagggagccttgacggaagggatgcaggtgattgatgccccgactcctatgcttacagaaggaatggcagtaaccgtgatttcaccggttcagtaagggggaggaagtatgtggaaaaaaaaggataagcttcctgcccgcgtaacagagaatgttaaggaagatttgataaaactggtggatgtggtaaaggtttacgataccggctccattaaggtgctgggattaaagcgggtaaacttaaccattaagcggggagaatttgtagcaattatgggacagtccggctcaggaaagtcaaccctcatgaacattttagggtgcttagaccggcctactatggggcattattatcttgacggcattgatacggcggagcttccggccgatgatttatcagccatcagaaaccgcaaaataggatttgtattccagtcctttaatctcatatcaaggacctctgcattaaaaaatgtggagcttcccatgacttatgcccatatatccaaaaaatccagggaggagcgggctttaatgcttctggaacgggtaggtcttggaagccggtatgagcacatgcccaatgagctttccggaggacagcggcagagggttgccattgccagggcgctggcaaatgagcctcccctgattctggccgatgagcctacgggaaacttagataccgcctcttcaaaggagatcatggagctgttttccaagcttcacaaggagggagctactgttgtactggtaacccatgaagaggatattgctgcttttacagagaggatcatacgttttcgggatgggcagatggtcagcgatgagctcaatgttcctcagatccaggaacaggaagagtctgaaaatatggagaaagaagggacgccatgctgttagaaaacatgagtatggcgcttcacgccatacggtccaataaaatgagatcctttttgaccatgctgggaatcatcatcggcattggggcggtgatcgccattgtatccgtaggagacagcatgaggaatttattttccgatgcctataaggatgtaggctttaaccgggccatcattatggtgtcctgggatgtgacggattttcggatgtcggattattttaccagggatgaaatggaccgtgtcagggacgtttaccaggataagatccagtatattgacagcgatgccagtgccgatgcagaggctgtcaatgggcggagaaaggttaagtatcaattccaggggattgattccaattataccgatgtacagccattggatatcatttacggaagagccatcaatacggcggatgtaaaaggagcggcaaatcatgtggttttggaggataagggggcggtggagctgttcggcacggctgactgtgttggcagaaccttccgcatgaccattaataaagacacccaggagtatatggttgttggagtctatcataaggatatttccccatgatggccatgttaatgggaaacggacagacccagtcagggtttctgccttatacggtcctaacaaaatccaatgatctttttcaggacttgaatttttatgtcagggatggagtggatatgaatgcattcctgtcggaacttaccaggtacgtggcaaagttaaagggccgcccggaatcagagatccggaccatgtccgttgccgagcagatgggaagcgtggatgccggcctttccggcatggcggccgctgttggcggaattgccgccatctctttgctggtaggaggcatcgggatcatgaatatcatgatggtctccgttacggaacgaaccagggaaatcggggtccgcaaggctcttggcgcgaggacaagagacattatgatccagtttttgacggagtctgcctttatgtcggcctgcggaggaatcatcggaattcttcttggagtcgctcttgtgaaagcagggggagccgcttttcagatgaccgtggtcatcaggccctctgtagtggtcctggcagtaggattctcggctttagtaggtatattctttgggctttatccggcttccaaggcagcgaaaaaagatcccattgaagccttaagatatgaataggaggggaacatcatgctgctggaaaatatgagtatggccatacatgccatcaaggccaacaagatgaggtcctttctgacaatgcttgggataatcatcggcattggatccgtcattgccattgtatcgatcggagataccatgcggtttatggtatctgacctttataaaaatgtgggagttaccctggcttatgtctatgtctggccaaaggatggggaggatatgaggcaaagcgattactttaccctggacgaaatggatcgggtgaaagaggtattcggagacgaaatcacctacttagacagcaatgccagcgtcaatgcagaggctgtctttggacgcaataaggtcaagtacgggtttgaaggaatctacgccaattatccccaggtccagaagatcgacattatctatggccgcaatttaaatgaggctgatattaaaggaagaaaaaacaatgtcgtgctggaggcaaagggggcggaggctctgttcggaatggaaaatgcggtgggaaaaaccttccgcaccaccatttacggcgttacggacgattacaacgttgtggggatctaccggctggaccagaatccctttgaagcaatgatgtccggggccagcgagaccagggcaggatatgtgccggataccctgctgacctggcccaatgacaacatttacagcctgcgcctttatgcaaaggagggaaccgacatgaattccttttctgaaagattcacctcctatgtggcaaagtccaaaaaccggaacaaggaagatgtcaccttttattctgtgtccagtgaaatgggaagtgcggacacacttatgggaggcctgtccgctgccgtgggagggatcgcagccatctcccttctggtaggaggaatcgggatcatgaacatcatgctggtatccgttacggaacgaacaagagaaattgggatcagaaaggctctgggagcaagaacaagggatgttctgatccagtttttaaccgaatcagccattctttccgcctttggcgggatcctgggagttgtggtcggcggaggacttgtgctggcaggaggagcgctttttggcctgtcggtggtgataaaaccgggggttgttctggtggcagttggcttctcggcgttggttggcttgttcttcggcatttaccctgcttccaaggcggcaaaggcagatcccatcgatgccctgaggtatgaataaagaagtgcgggagacctgatgagcccagagtgaggataagttatattatgggaagtaaaaagcacttcccataatcggatgaacgggctgaaaacagcccttttatcctcacttgcgttgcaagtttagataagttatattattacaggttggaaagtcttatggatacagactttccaacctgtttttgcatattggatacagattttttattattcttttaccccttccaaaaatccctgaaattcatgaaagtatgtttcttctatttttttcatccacaccgtgatccttttatcagacagccggagcaggaaatggatggaccccacacattctcctgcgatctggaccggtaagtacagggaatcgggtccggcccacactccctgtacggctattctctgtttatattcttccagaatgcttactttctggctgtgaaaagagaatggaatatgaaaggcagagtcaggggcggagagaacaagggtaccatcttccagaccaaaggagagggaaagcctggaaaaaccgcctggatttgcacaaagcccgtaagagacatcccaggctccgggacctttttgcttccttatctgttccgggccgctttggatttcttcaaccgcatcatggatcaagtccaggatcttctggtttccgccttttatattttgtgtatccgctgtgacaacgaaaatcagatcagaatcaggataaaaaaggacatactggcccccatgccatacatggcaaacccattccggatgcgccagaactgatatccgtatccatgctgttcatctgtagtctgaccgaaatgaatggtaggaaccttaaaggcaactgcctctcttaaatactctgcaaatttccctgttccattttttatggtatccatacagaaccggcccagctttaataagtccatggggcgggccatgaggccggagcctcccatttccgaaccaaatggatccgggatgatgtaagcctccttggagaaaccggtttcatccaggcatttttcccttagataatccagaaccccttttcctgtcagcttttttacaagggcagccagcgtatggctggaagaggtgtcgtaaagaaatatctgaccgcttctgtgggtgggaggcgtggtgaagaagctttccacccagtttttgcctggatccgctttgtatgtggtggcggagtggcaggtttccatggaaagcatatggcgtatggtcatctctttcagccagggatgaatctccccgcaggaacagtattccgggaaataatccgtgatcctgtcatccagagaaagttttccatctgcataaagaaagcctgtggcaagggaacaaaagctttttgtaatggaaaacatgcggtgaagatctgaggcagtatagggggcattataagtctccttcaaaatcgtgcctccctgttcggcaagaaagctgtggataggcagcccgctttccttaagcctgagccaaagggcttctgtaagttccggaatattcttaaatctactgttttgcattgactttatccctcatttcctttggtgatacaccaaaattctttttaaatacccgccggaaagaggcggcattgttgtatccaagatactggtacaggagcgacagacttgtgtcagattccaggatcatttcctttgcctttgccatgcgcagccgctctaagtaggtggaaaagttttctgatacctcttttttaaacagataactgaaataattttctgaaatcccaaactcatcggaaatttttgtcaggcacaaattggcatcgtgatagttgctgtttatgtattcctgtattttaaggatcagttcatttccttcggagccgcatacgtcacacagctggattgcaatggttttcaagctgtccaggctcatctctccttcaaactgcttgtcgatcatgtccaaaagctttaatttttcaggcgccagactgtctgtgatgatgttgtgcctctttttgaatacagtagcacgtacatcggagatcagccagcgctgctgggtgcaggaaaggtttctttttccggtgttttcattcttaaggagcttaaacagctcacggacctggtccttgtttcctatggaaataaatccgcttaactggacggaaaggctttccgggtaataatagacatcgctggaatgagtgaaatcacagcttaaaatatatttttccccagtggtaatggatttcgcttccttagcctgctggtaggatttccatgtgtaagagatgaaaccgtttctgtctcctaatcctccgctgatccagattccgtacttttccagaagctctttgtgcagggcaataaaaatatccctgtcccggctgatggtctgagtttgggggacagatttgtcggaggcaattaaaacggcaaatacccggtcagacggcttgtatatatatccggtatcaggatagtagcggcgcagggcctcccttaccagcatgtcatagttctgaaggcacagctccagatcattggagcggatcatggaatcctcggagggggatacctcggtgtataaaacgtggaatttcgtatccggccggtctaaggaaagctcacttatgatgtactgcatttcatcgttggtggtgatgcttccttccatgatccttctcatgtaggattcaatgaccacaggcttctgcttttccaccagaaggtttaaagaggtggccatggactccgttacggtcagttcatttgccagctgggtcaggcagcggctgccgaaggaggaaaaaactcctgctatgattccgccgatgacaaaggaggcaatggtaatggccgtaaaaaaacgctggtaagggaggatcgagtaataagctttgtccgcaggctggaccagataataggtccagttattataggaagaggaaaccgtggtcactaacatttccctgcggtttccctttggggcgaagtgggcggtctggttactgtaatccagtccttttaaggtgtcaaagctgctaacttccccgcgcctgacagaaggaatgcctgggagccgttcttgtcgtaagcaaccaggtacccttctccatataagttcatgtctgaaaaatatgctgtgatcagatcgtagtcgaattcataacacaggacagaatctgctcccgccttaacaactgaggcggagagaggctggatgtagagaaagctcctggctgtactctgcaaatgtccgaaaggaatgaatttgttccaaaacacgctgtttaaaagggcgtcggaaaactgtttgggctcgatctgatacgttgtattgtgccggatataaaaattataatccgaaaacagggtggaggaaactgcgtatttggaatttttcatataaataaaagaattgctgatgggaagcagaaactctaccggagtaatggattttaaactcagctgggtctgataggccagatggtaaaaatcgggtccttcctctcctgtgagatgggaaaggtcattaaacaggatattggaggaggtctgccttgccgccgcattcatcagcttcatggtgtaatcaagctgagtgacagaggaggagagggtgagccggttctgcttgttgatgccgtttttgacctgacagcaggagatgtaatacaggatcactccgataataagaattattgccagtatcataatgtaggacaacatcagctgatttttaaatgggatgctgttgttttgttttttcatgtttaccattccttttttcgtatgaagaaattatagtatgaatcattatcaaaatcaacaaattgggacaaccggataaaatctgcacactgataataagaaatgtactcaaaaataaccgttgttttgtcatattatttgttttgttccatgattgaaaagaaaaatggtaccatttgcacaatgaatttttgaaaaataaactgctgcagaaaaaagtgaacaatgacaggtaaaactgtgcgttgatatgccggagatcagatgctatgataggcaatgcgaaattcgcacaacaaaaactcttatgggaggtatgaaatgagaattaagaaaatgcttgcagctggaatggccgtgacaatggcggcctctgtcatcttaagcggatgttcctcaaagactgcagaaacgccaaccaccggttccggatcagctgccggtgaaacaacagcggaaaatgagatcaaaaagccggaaaagattaccgttttagtagacggaacggtaaccaccaagattaacaacagagatgcctttgaaaaaaggtgggaggagcttaccggtattgatctggaatttatacagccagatcatgacgcctattatgatgtggttggacagacctttgcttcgggtcctgataactggccggatgcaataatcctgtcctcttcctattataccgggtatgcccaggagggtgcattgtgggacatgacagatacctgggagaattctcagttaaaggcttccggccgtgtaacaggtgaggatgtaatagataatatgaagatcgacggacatttatatggacttccggttaccagagggaatggctgcatcacttatgtaaagaaagcatggctggacaattgcggattagaggttcctgaaacatatgacgagtatttgaacatgctgaaagcgtttacagagggtgatccggacggaaacggagtcaatggggacacctacggcgtttccgcacctggaatcgttggaacagaagctccttttgtaaactatctgccggaattttaccaggatgcatatccttcttttatcaagggggatgacggcgtatggtacgacggttttgcaaaggacaactttaaggaagccctgacaaggctgcgggaagcctatgcagccggctatattgataaagaaaccctgaccaacggaagcaaggattgccgcaataagttttatgaggataagttcggtgtatttacttactgggcaggcacatgggcaaccaatttaaagagcaatctggagaaaaacgggaaagacggggagctggttgcattaaagcctcttaaggaaacaggcagctatatcgagagaattcctcctgtatgggcgattacatctgcttgtgagaatccggaaggtgtgtacaagtatctcattgaatccatgctggatggaggagatatgcagactttatggacctatggagtggaggatatccactggtcgacaaaggcagaggccgtgctggacaattcatatgaggaaggcgtgttccatttaaaagaaagcctggagttcccaggtacccagtacacaaaacagcacatggaccccatgctttccatagcggaatgggatagtaatccagggaaagatactgtggaggaatcagccagggaatcccagaccatgtttaatgaaaactgccgccaggcccagattgtgccttctactgaggtgatggcaacctataacggagacttgaccacgttaaagaactccatcattgcggacgttgtggtacaggggatctctattgaagaaggttataagcgctttgaagccgaaaacggggcaaaatggtcccagatgatcgttgattccctgaatgaacaggcatctgcaaaatagttcaggaaggtagagtatgagtaaaataaagaaaaggcctgcagcaaatgctgcaggcgaaaataaacggcctctgcttgtttcgatttattattacagaggattttacatgatgtttcttcctgttcttatttttgcagtggtctttcattatcttcccatgttcggaatccggcttgctttttattcctataaaggcatcaaggatcctgtattcgtaggcctggcaaattttgagaagatgataaacatgcccgggttttggaacgccttcggcaataccataaccttaagtgtcacgaagctcctgttaaatactttcatgggagttgtactttctcttatgctcaatgagcttaaatccctgatatttaaaaagttttcccagacagtggtatatcttcctcatttcatgtcatgggtagttactgcctccgtctttaccctgattctgtctcctacaagtgccggactggtcaactccatattaatgaagcttggcattgtaaaagaaggaatctattttctgggaaaccagaactggtggcgtcccatgttttatgtcatcaacgtctggaaggacaccggctggggaacgatcatcttcatggcgacgctttccggaatcagcccggagctttacgaggctgcttccatggacggggcaggacgctggaatcagatgcgttacattaccctgcctggactttccaataccattatcacggttctgatcttaaatcttgcaaaggtcatgaacttatttgaatccgtattcgtactgcagaatgatgcggttgttcagaaggcggatgtacttcagacttacatatacacacaaacatttaattccggggctcttcctgactacggctataccacggcggtaggtctcacctcttcgctggtaggctgctttcttgttctgatctgcaacaaggcaagccacaaggtccgcggaagaggaattgtatagaggggagaaagaaatgaaaaagaaagcgaccgcatttgactatgtgctggtgttgatattcgtgttcataagccttgtcatgattatccccatatacaaagtccttatcgattctctggatttaaaaacagcttacggtatgaaactgtttccagaggagtttggcctggagggatacatttccgtattcacaaaccccactctgtaccggccatttctggtatcctgttttaccacagttgcaggcacttttatcggacttaccatttccactttgggagcgtatgtcctgatccagtggaaaatgcccggcagaaatttttttgcaaaccttctgctgtttacgatgatatttaacggcggtatgatccccacctatttagtgatgagggggcttcacctgaccaataccttatttgtggtaatccttcttcctgccatcaatgtttacaatatggtactgatgagaaacttttttgaaggaatcccggtaagcctgtttgaatctgcggaaatagacggctgttcccctatgaggattttctttggaattgtcctgcctctttccaaagcagctcttacagccattggtctgatgtatgccgttggttactggaatgactacaccaattataagctgtacatcaccaatgaaaatctttacaacttccaaatgaagttaaggtctgttataatgggaagtgatctgcccactgcagttggaggagccacggagaatacggtgaagaatgctgcggttattgttgcaatcctgccctttatgatcatatatccgttctgccagaaatactttattcagggcgtcaacatcggagctgtaaaggaataaggcctggcaggaaaaggggcagactgtctgtccctttttctctataataaataaaataaaaacgggggtaataacaatgtatcaaaatccggttttgtatgcagattattcggatccggatgtcatccgggtgggagaggattactatatggtggcctcttcctttacttatctgccaggggttccccttcttcattccagagacctggtccactgggaaattatcaactattgcgtccgctcacttccctttgaaaaatacaacaagccttcccatggttccggaacctgggctccctccatccgcttccatgacgggatattttacgtgttcgttcctctgccggatgagggaatctttgtagcccgttccgcagatccttacggagagtttgctttaaactgcctacatcctgcaaagggctggatcgatccatgtcccttctgggatgacgatgggaaggcctatatggtatttgcttatgcaaatagccgcagcggaatcaagcaccggctggatctggtggaaattgactcccagtgcacaaagctcttgggagagccggtcactgtttttgacggtaagcagctggcacctaccacggaagggccgaagctttacaaataccagggctgttattacatactgatgccttccggaggtgtggcaaccggctggcagtccgctctgcgcgcaaaatctgtcacagggccatatgaataccggatcgtcatgcaccagggaaatacggaggtaaatggtcctcatcagggaggctgggtaacggcgaacgacggcagacactggtttattcatttccaggatgtgaccgagctggggagaatcacccacctccagcccctgtgctttcatgcaggctggccctttataggaagtgagcagaacggagatgggatcggagaaccggtgaaggaatgggatctcccggttcagggacagccggagtaccgggttgtccagtccgatgatttttgcggcagcagcctgggacttcagtggcagtggcaggctaaccctcaggatttcttttattccacaaaggggcattccggcatacggctgtactgtcttgcaaatccggcaagagaaaaccttttatggtatgcccccaacgctatgacccagatacctcagcaccaggccttttctgcggtgacaaaggtaacgcttaagggaaagatgacaggggacatggcagttatgggcatgatcggccattcttatgcatacatggggctgatgaagacggagaccggcaatcagctggttctctattccggaactgtgatacagaaggaatacgagggagaagccagggagctccgggaagtttccttcccctttgaaaacgacggggcttatcttaaggtagaagtgttccgaaacaagacctaccggtttttctggtccggggatggaatacactatacatccataggaggggactatcccctgcgcagagctacctggaccggggctaagctctgtctctggagttccaacaataagaatgtaatttcagaagggtacggggaatatgattttatacacatcgaagacagaagcagctgcgaaacaggcctttgaagccgcaataagaggggatctggaaagggttatccgcctgatcgatcactcctttaatacggaagactgcgatgaagagggcaacagcctgcttcactatgcagtaaaagggaaaaatccggaccttgtaaaatatttagtggaaaaatgcggtatggatcctgcctgggccaatcaggacatggtaacaccctatgacctggcaaggggcatttctcccatggaagactactttcagtcggtctgcggcttttcctatgaggaatgttaccggaatccggtttgcaggggaatgcatccggaccccagcattgtccgggtgggggaggactattatatggttaactccagctttatttactttccctgcattcccatttcccattccagggatctggtacactggaaaaccatcggatatgctgtgacagaccggaaatgggcggaggaatacttaggagagctggagggcggaagaggcttttgggctccggatatcagccatcacaacggaaggttctatatctgcgccaccttgagaaggaatgacgatgcaccctttatccagacccagatgatcaccagctccgggaatccggagggaccttatgaaacgccggtcatccacaatgtacttggcatcgacccttctatctttaccaatgatgacggaaaacggtacatgcttttaaaccggggagcccggatcatggagatatcagaggatggaaagcagattctctcagagccgtcccttatatggtacggtcattccggccatgcgccggaggggccccatataataaaaaaggatgggtactattactgttttcttgcagagggaggaacgggaaagggccacatgatcactgcagcaaggtcaaaaaacctgtttggcccatatgaagactgcccctataatcccattatgcatcaaaaggatgagatcgggagcatccagtgctgcggtcacggaaagccggtccagactccggacggaagatggttcatcgtatacttatgttcccgtttctcagaaggccggtgggggatgctgggcagggaaacctgcctggatgaaatgacctggtcaacggacggctggccggtcattaaccggggaaaagggccatcctatatggcagctttgcccttttcggcaatcagggggcagaattttgggaagaggccggccggggaatggctttccccagaacaaaagatccgcagatcaccggcgaagccgctgatggaaccatatggatcagaggagatgggctggacttatatgagagggattgtaagagccttttagtgacgagtcagcctgatttccgcttttccctggaatttgaaatgagttttccccaagaaggacaagaggagtttacttcggacgcaggggtaaccctttattatgatgagaatacttatataaaattcggcgtaacaagagaccgggtatttgtatctgaatatattgacgacacctatgtaagaacagaaacaaaaccgttccggtttcaaagtccggtaacattccgggtggatacaaacgggcttataagaacctttctattaaacagtaagcttctgtggcaatggacagatgtgacctccatctgttccgagggccttgtaaaaggcaagcgctttacaggagccatgtatggagtgtacgtaaatggcagcaatcttttatgctggagacagcacagtgaaattcaataaaatatccgcctatcccaaaccgggatttcccaggcattgttgttatacttaaaggattccgtggaaatgaaaagctttgcccagaatgggcgcagcacaaaatcttttattgacgagggacgcctggatctgatcggaaaagagataaaggaaggcgatttcctctttatccagttcggacacaacgatgagaaagacgatccggcaaggcatacggatccggacaccacatttccggagaacctcatgcgttttattgacgcagcaaaggttaagggagcctggccggtcctcataacccccattgggagaaggctttttgatgacaggggaaccttcaggccgggaagccatggtgcttatccggaggcggttaagcggacaggaagaaaggcaggtgtgcctgtaatcgatatgacggcaatcacagaaaattatctggcagctctgggggacctggcctctaaggcttatttcatgtggcctaaggacaatacccatttaaggcctgagggagcagttcttatggccggttttctcagcgatgagctggaaaagctgggatccccttatagggacctcctggaagaaagggcagagcagagggaaaatacggggtttgatgtttcttaaggagcagattatggatcattatgaagaaattgaacgccgttttgtccggtgttatgaaagatacgggaatcattccgtcaaggttcttcttggtttttacaagggccagtatcacaaatttctgatttccaccttctttttcgtgatcaagcatgcccccagccttttttcggcactgctgatcgccaatgtgatcaatggagctttggaaggaggagaggccggaaaacaggccattttgttaaatgtggcggtctggctggggctgcttgtcatccatcttcctgccaactggcttcataataaatacaaaaacaaggtcatacgaaaaaccgaagcaggtttaagaggagccctggtgaggaagcttcaggaactttctatcccttaccacacgggaatccagtcaggacgtcttcagtcaaaaatcatccgggatgtggaagcggtagaaaccctgtcatcccagctttttgtaaacctgatgaacattatgatgaatctggtgatcaccctgtccattacagccgtaaaaaacagaattgtccttttgttttttctcctggtagctcctgtgacctctgtgaccgtgattgcattccggaagaaaatacacagagaaaacagagcgttccgtcaggaaatggaggaaaccagcgcccgggtcatggagatggtggagctggttcccgtaacaagggcccatgctctggagcagagggaagtggaaaaaatcaaggagcagctggaagaaactgcggataagggatatcgtctggatatgatacaggctcatttcggtgcggtcagctggtgtgtgttccaggtgtttcaggctctctgcctggggttttccggttttatggctttaaagggcctgataaggatcggggatgtgaccttttatcagtccagctttacaactgtggtaaaccagttcactgccctcataaacctccttcccatcctgacaaaggggctggaatccgttacctccatcggtgagattttagcttcagacgatgtggagcataacgatggaaagagggaaatgaaggcgctggatggaagctattcttttcgcaacgtgcagttttcctataaggattcccaagaacaggtgcttgatggattccagctggaggtaaaggcaggggaaaccattgccctggtaggagaatccggttccggaaagacgacagtccttaacctgatcatcggattcatcacgccctctgacggaaggcttttgattgacggtatggatgtcaacgacattaacttaagaagctaccgtaagtttatttccgtggtcccccagtctccggtcctttttaccggaaccgtaagggaaaatattgtttacggtctggagcgtgtttcggaagaggagatcgggcacgccatagaagcggccaatttaaagtcagtcattgcgaagcttcccaagggtcttgataccatgatcggtgagcacggtgccaatttaagcggcgggcaaagacagaggatctccattgcccgggcaattatacgtgacccgaaagtcattatactggatgaggccacttcagctctggataccatatcggaaaaggagattcaggatgcgctggatcgccttattaaggacagaactacctttattgtggctcacaggctatccacggtcagaggcgcggaccggattgtggtgctggacaagggaaaaataagagaagaaggcagctatgaggagcttatggcccaaaaggggaattctatgaaatggaacggctccagatggctttaagatgaagaaatcggtgcccggacttgcatcccgggcaccgatttttctgccgtctgagcctggtataacagctgtgctctaatatcttgtacgatataaaaaaataaaaattccgtattaggctcgcaaagtaaaagtttctatgctataatagggtgatatcttatggtatagtgaggaaaccatatgcttagtgaagaaaaaattaaaattatgaccagccttgcgatgtttgaaaaacatgaaggaaagcggatatttcccattaaccggtacttcaaaagtgattacatcagcagcaagctgttccgctcctttttcagttacaccttaagctttgccttatgtctgatcttatgggtattgtatgatttggaacggtggatgaacaccatggaactgaagggcctgacgtcggcagggctgcggatcggcatgatttatctcatcggactggtgatttatctgggaatcagcatttttgtatatatgagacgatacgaatatgccagccgcgggataaaggtgtatctggccaaattaaagcggctggacaagcggtatgagggaaacaccagacccttaaaaagaacaaagggaggacggacatcatgatgggccttcttgtatttaaagaacgaataaaagagttctacgcgagatttgaaatctatataacgcctgtgatcaagttcattttcagcttcctggcgttttccctgatgaataagaatattggctttatggcaaagctgacggacgcctatatccctgtggttctggctctggtatgctcctttttgccctatggagccatttcctttctggcggcaggctttatgcttgcccatctgtcgggaatatctcttgaaataactctggttatggctgtttttattgtggtggtaggacttctttattatggatttcagccgggtgacagttatttgctggtgctgaccccggtgtttttccttttaaggatcccttatgccatccctttgatcgtggggctgtcagggagtgtgatctctgtgataccggtgagctgcggtgtatttatttattatgcacttttatatgtaaagcagaatgccggggtcctgacaaacgatatgtcggtggatgaaatgcagaaattcatgcagctcatgaagagtctgctttccaataagctgatgcttgtgatggttacagcctttgccctttcccttgtggtagtggcaattacccgcagcttgtccgtggattatgcctggatcattgccattgtggcaggtactattgcacagcttggggtaatctttatcggggatattgccgcagatgtgtcggtatcagtgatcaggctcctggttggaatcctgatttccatccttattgcaggaatttatacattttttgtctttgcggtggattattccaggacagaatacgtacaatttgaagatgatgattattattattacgtcaaggcggttccaaagctgacggtcagtgcgcctgacgtaaaagttcagaaaatcaatgccagaaaactccaaagaccgcagaggtaaaaataccctacgggcataccttaatgcccaaaaagcagggcaataatcaggaacgccctacgggcataccttgatgcccaaagaacagggcaataataaggaaaagacaaaagggaggtggagacaatagctgattttttagacggaatgtactcctgggtatcgttcctgcccagaatatcgaaaacaaacctggttgaaattattattatagctgtactgctgtatgaactgctgacctggatcatgaatacaagagcatggacgcttttaaaaggaatcattgtgattcttcttttctatgtctttgcatatgtattccggctggataacattttttggatccttaataaaattgctacgcctgccgtgaccatggcgattgtgatcttccagccggagcttcggaaagccttggagcagctgggaagcaaaaatccctttacagggatccttacctttgatgacggccgggacaactccagctttacggataagactatcaatgagctggtaaaggcgacttttgaaatggcaaaggtcaagaccggagcgctcatggtaattgaaagaggggattccctaaaagagatcgaacgtaccgggatcgaaataggaggggttgtcagcagccagcttcttattaatatatttgagcataacacgccgctgcatgacggagcggtggtgatcaggggaaaccgggtggcagctgctacctgctatctgcccctgtctgacaatatgaccatcagcaaagatttaggcacaaggcatagggccgcagtaggggtaagcgaagtcaccgacagcgttaccatcgtggtatcggaggaaacggggcgtgtgactgtggccttagagggcggtttaaaacggatcacggatgcggatatgctccggtcggtccttgtaggcgtaaaacaggaggcagtggaaggaagcagattcaggatcttgaagggaaggcgtaagaatgaaggaaaagctgttaaataatcttggactgaaagttgcgtccctggtgcttgcctttgcagtatggatggctgttgtcaacatttccaatcccatcattgacgattcccaggtggttccggtagatgtgcgcaatgaggatgtgctggaggatgccaatttaacctatgaaatcgcgggaaaggatacggtgacagtcagttatcaggtgaggacaagagaccgctctctggtgagggcctcggactttcatgcctatgttgatttaaaggattacaatgtgacgggagccattcccatcacagtggagattaataaagataaggaaaatctggtgaaaaacgataccattacggcaaagcccatggtgatcagaatcattacagaagaacttcagcgtaagaagtttgaacttaggtacgatacaaagaatgaggttgaagacggatatgccataggcgtggtcactctgtcgcctgactctgtgacggtggaaggccctgagtcccagattggcaagatcaattatatgggaatagagatcgatgtggataatgccaatgcggatttgaattcagtggcttttccgatcttttatgatgccaacggcaacaaactgacggacctgggagatcaggtaactgtcagcaggcaggagatcgaataccatgtatccgtgctgaaagcaaagaacctttcactcaattttgaggtttcaggagaagtggcaaagggataccggtatacgggagtggaatccagcgtcaaatccgtgcctgtggtgggtaccaagtcggttctggcttccttgtccaccttatctgttgcttcggataagctgaatgtggacggcgctacctctgataaggtggttcagctggatttaagccagtatctgccgccaagtacttccgtggcaagggaagaatataagaatgtaaccgtgaagctgaaggtagaaccgctgaccaccagagtattcactttgaatctgaaaaacctggagatggaaggggcagaggctgattacgattacagctttgacaaggagacctctgatgttaccataaaagggctgaaggaagacttggatgccctgacggaagaaaacttaaacgcaattcttgacgtatcagaccaggaagccggccctcatcccggaatgctgaaatttgaggtttcaggtggatttgaggtggttggatatacgcctttcaatgtgacggtggcccaaaaagatcctggccccggaacagaggaaagcgccacagcctcttcgacggaagagtctgagtctgaataagaaaggcttttgcttccggaaaaaggcgcaaatgataaaggaatagagggagggaattcaatatggtcagtgcgaaagttgttataaagaatcctaccggcctgcacctaaggccggcagggattctttgtaaggaagccatgaactttaaatctacggtgagttttcggtttaagaataccactgccaatgcgaaaagtgtgcttagcgtattgggtgcctgtgtaaaaagcggggatgagattacttttgtctgtgagggagcagatgaggaggaagctctggcaaccatggtcaaggcagtggaagagggtcttggcgaatagattaattgtttaataattaataaggaggagaaattatgtttaaaggaacaagtgcatccgcgggaattggcatcggaaaagctgtcagcgtggaagaagcggaacttaagatcagaagggaagctatcacagatccggcggctgaaaagatccgctttcaggcggctgcaaagcaggccatggaagaaaccgatgccttggcgaaggatctggcaacaaaagtgggagaaaaggaagcggagattttaaagggccatttattacttctttctgatccgatgctgacaagtgagatcgagaatacgatcgacggggagaatgtcaacagcgaatatgccattgaaaatgtatgcaacacctatgccgatatgtttgcctctatgggagacgagctgatgcagcagagagctacggacatgagggatattaagacccgtgtgcagaaaatacttatggggatcaactcagtggatatttccgcccttccggaaggaagcgtgatcattgcaaaagacttaaccccatccatgacagctggtattaatcctgagaaggtagtgggaattgtcacagagctgggaggaaagacttcccacagtgcaattcttgccagagctttggagattcctgcagtggtcgcgttggagggctttttaagccaggtatccgacggggatgagatcatactggatggctcaaagggatttgtcatggtgaatccggaagagtcggtgaagacagaatattccgcaaagagagaagcgtttttaaaggaaaagaaggaactggagcagtacatcggaaggcctacggtgacaaaggatggagtttccattgaactggttgccaatatcgggaagcctgaggatgtggaaaaggtccttcattatgacggggaaggaatcgggcttttccgtacggaattcttatttatggaccgtacgtctatgccaacagaggacgagcagtttgatgcctaccggaaggttgcggttgccatgaacggcaagccggtgatcatccgcactctggatatcggcggagataaggaaatcccatacatgggccttaaaaaggatgaaaacccattcttaggataccgtgccatccggttctgcctggaccggaaagaagacgtttacaagcctcagctccgggctcttttaagagccagtgctttcggcaatatccgcatcatggttcccatggttacctgtttagaagaatacagggaagcaaaggcacttgttgaagagcttaagaaggaactggatgaaaagggacttgcctataaaaaggatattttagtgggaattatggtggagacggctgcagcttccctgatggctgatgtatttgcaaaggaagtggatttcttcagtatcggaaccaatgacctgacccagtacaccatgtccgtggacagaggaaacgataaggtatcttatctgtattccccattaaatcccgctgttttaagaagcatccgtcatgtcattgaatgcggacgcaaggaagggatcatggtcggcatgtgcggagaggctgcaagcgaccccatgctcattcccttgcttttagcatttggtttaaatgaattcagcatgagtgcatcagcgatcttaaacgccagaaagctgatcaccggctacagcacaaaagaactgcaggcagtggcggaaaaagctatgacttatgctactgtaaaagaagtagaagattacatgagagagttcatcagcaatacataatggactcgcagagaggaagggcagctgccgccggggcggctgctgccttttccgtaaagtctttcttcgcaggaagggagtggagtgaaataaatacgatgagcgtttatttaatcagctatggggcttcttatttatttgcaagagcgcaggtttactggctgtccggtattgttttaatgctggcagctcttttcctgtactggcgggattacagcagaaccgagaacatcattcatttaaggggcttgttttccctgttttgggtaggaggggaaggcatcgcctgtttaaagctttcggagctttcctttgattggaatattattacgtggctctgctttctcgtagcattcctgggattttgggtcacgtttgaatttatggcaaagctgcagggagaatcagggggcagcagcgttccagctggttcagctttaaaggctatgaaaaacctctttttctgtcaatggcttttgtcacttttgtatcccttgccggctttgttgttgaggcggcagtgctggggttcattcccttctttgtgaaaggagtgcctcatgcttactccacattccacatcacggggattcactattttaccgtatcctgtgtcctggtgcccgccttgtcagtcctttatttttccattgaacaggggagaaatggcttaaggcttgtactggccgttcttatggatgttatcgcatgtgcgattcctgttttgtgtgtgtcccggttccagctgattctggctgtgggattagcggtcctcacctatattgcaatggagcacaggctgaaaatcgcctatggagtgggtcttatgatcggcatgatccctatttatgtgattctcaccattgccagaggccatgatgtgtcttatttaaacggcatttttcagatgaagaacagtcagatgcccatattcatcacccagccttatatgtacattgcaaacaactacgataactttaactgcctggtggagtggcttccgtcccatacttttggccttcggatgctgttcccctatgggctcttacagggcttaagttcctggttccggcacttgtggattttccaatctatgtgacaaaggaggaactgaccactgtcaccctgttttatgattctttttatgatttcggcattgtgggcgtcctgctttttggctgcattctcggtgctgccggatttttccttatgcggatggcaaagcgcacgagaaatcccatgggctatttgttttacgcacagtttgccatgtatatgatcctttcctttttcacaacatggttcagtaatccttccacctggttttattttggaatgacggggattttgtacgctttttgctcgtggaagaatgatggaaggcatggatgagtttaaacgcttatcctgaaataaacaacagaacagatgaaaagaagttttattttataaaataagcagcaggcataaggaaaaaccttaaaatgcctgctgcttgttttatatggtatgtaaattgcggtggaagcattttaagaaacagtggtgtcttccttctctttcttaggctgcggcaaagcaggattttttttctttctgccctttctgaggaagtaagaaacgatccctgcgacaagtacaatgggaagccaaaaaggtatgcttatgatcacgccgattaaagagtttgtcatcatggttttcaaagcttgaaaattattagtaaatcctctgctgatgcgggtaagagctgattcagcagccacaggagtaaatatagtcacttctcttattgttaaatggaccgtactgtaatccacctgattgtcgtaaagtctcagctgggattccatggattccatctgatagcgtatttcggaaagccgctgctgcagggtgatgaccgtgtcaacggattccgctttttcaaggaattcccacagcttttcctgctcgatttccagggattttttcttgctttccaaatcgctgtactgcagcgtgacatcctgggtggattcggatttatctgtcacatttccgttggtttccactgtgcttataaagctgtcgatctggttcactggaatcctgatggtcatatttgcaaaccttgggatcggttttcccccgctgtctaagcggctgcctgacatatcggactgctccacatacccgtcaagctgagtgattttggtctgcagtgaacttaccagggtatcaaatgcatctgtttccacgttcatggatatgttccgtatgagctttcttcctgccggaagcattgggccgcttcctgtttcactttccagtgatgcagcagctttttcctctgttacattttgctgctggctgtctgcgcttaccgagacacttgtctctgcctgcatggctatcccataatcaggtgcggcaccctggatcattgtcccggacttgccggcacaggcactcagacagaggactgtcaaaagagacagagcgattccccatgtcctttttctcataaaacccctccttttatcatcatatttccataaattatgtgatatccttagaatagcatgagacctggaccatttcaactaaagcgggtaagtttaagaaaaacttatatatttccataatcttttgcagtttccgaaggggaaacgtgaaagtgctttttataggccctgaaaaacgtggagtagtttttaaagccgctgccaaagcaggcctctgtaaccggtatgccggtttttaaaagatctcttgccatggccaggcgcttttctgtgatatagtcaaaaagagtatagccggtttcggtcttaaacaggtgcatcaggtgatagcggctgatataacaggcctccgcaatatggtctacggttaactcttccgttaagtggctgtttatgtagtccataatgcttaaaatgcgccggtcagcggtagaaggaggtaagtattgtacccggttggccagggaagccctgtttaactggatcatgaattccagaaagaccacctgacagtataagtctccggcatagccgtcatgggtacaggcgtattctaaatttgccagtgtgcggtataagtcgcttttctccatggaatggatccgcaggacatgggaatgaagttctcttgatttctggaagcaggtgcttaggtcatagctgtcagaacggtaagccagtaaaaagcctggggaaagatagacgatgatccgttcatagggcactgacggatcgatatcaggtttgtgaatatcgttatggcggaccagaatgatgtcatagggtttcagtttataagcacagccttcgatccggtaggtgacagatccccggatgaagatgatgattttgtcaaagtcatgatagtggtattcaaaatcctgtttttttgtatcaatcagatgaaacagacggaagtcgctgtttaaatatccacgcttttcgtagttgtccatattgatctgattcctcctttttactgccttatattatgaaaacaaaagcggttttcataatcggatggacgggctgaaaaacagcccttttatcctcacttgcgttgcaagttcggataagctatataatacaacattatttgcaataaaaaaagcattatattgatagaaatgataaaaagtgctgtatataatgggtagtatagaacaaatgtgcaggaacagagggaagacggcaatgaaaatcgttgtgttagcgggcggcttcagcccggaaagagaagtttcattatcctcaggagccatgatcacaaacgctctgatgaagaacggtcatgaggtttacctgctggattcttatttgggagtggccgatggggaagaggtttgttttgaaagcctgaaagaaggtacagatctttccagggaaatcggcaaaggtgtaccggagcttgaccgcctggcaaaggagcggaagggaaaaggatatattgggaacagggttattgaaatctgcaggaaggcagacgtggtatttctggccctccacggaggcgcaggggaaaacgggcaaatacaggcagttcttgatgcctatggaatttcctatacaggcaccggttatgaaggctgtttaaaagccatggataagcctatggcaaaactgctgatgagggaatcaggcatattgacaccggactggcgcctttataccagaggggaacctttggaaccattttcattcccctgtgtggtaaaaccatgcggctgcggttccagtgtgggcgttaccatggcagatgggaaggaacaatggaagcaggcccttgattctgcctttgcttatgaagaccggatactggcggaagtaaaaattataggcagggagttttctgttggcatcctgggggagagggcccttcctgcaattgagatcataccgaaggcggggttctatgattatcaaaataagtaccaggcgggtatgacggaggagatctgtccggcgaagctgacggcaaaagaggaagaggccatgggacaaatagccttaaaggtccaccggattctggggcttggttattattccagggtggatttcctcatggcggagaatggaagcatgtactgtctggaggccaatacattgccggggatgacgcctttcagccttcttccccaggaagctaaggccgccggaatttcatatgaagaattatgtgaggacattgtaagacatggaattaccctgcaggtatgccctgatgaccaaaaacgtgggcagtgaagaggaaaggagttttatcatgaatatcactttggaaaaatatcacggactgggaaatgattatctgatctttgaccccaataaaaatgaactggagctgacagaggaaagcgtccgcctgatctgcaaccggaattttggagtggggtctgacgggcttttggtagggccgatcctgggccaggataagctggagctaaagattttaaatcctgatggaagcgaagcggagttaagcggaaacggtgtacggatctttggaaagtacttaaaggatgccggatacgtgcagaagaaccgctttattgtcaacacattaagcggacagcagaccattcagtacttaaacgaagatggaaccaaaataaaagtttctatgggaaagctgagcttttacagcgatgaaattcctgtgacaggaccgaggcgggaggtgcttaatgaaaccatgatgtttggaagcatcccttaccgggtcacctgtgtgaccataggaaatcctcactgcgtcatctggctgaatgacatatcaaaggaactggcctgccggatcggaaagcattcggagacagctgattatttcccggaaaagatcaatacagagcttttaagggtggtggacaggaccaatatagaaattgagatttacgagcggggagccgggtataccctggcatcggggaccagcggctgtgctgccgcaggagcggcttaccgcatgggacttactgatcctaaaatgtatgtgcacatgcccggaggagtgcttgaggtggagattgaaaaggatggcggcgtgctgatgacaggggaagtgggctatgtaggaagatttatcctttcccatgagatgacggagcagctgcgggcactgcagtaacagaatataacttatccaaacttgcaaagtgcttttttacttcccataatataacaaattggcaatacgggcatgacagtcggccgttaaactggaacagggaagatgccctgtctgaggaaacggggattggagtgccttttgcatttttttctgttttcagagaggggcctgaacttgttgacggaaatagagttttcatactataatattacaataatttatatggtgcgtagataatgtaatgcaggagaggcgggagtgtatgaatcgtatgtcggatgaaaatggagaagccggtatttacatagttgaccagaattacaggatcatttatctcaatgatgcggctaagtcatattatccggatttaaaggaagggatgtattgttatcaggggattggcaaaggaatggagccctgcaaagactgtccgggtacaagtcaaaagtccgagcatgtgatattttataattccgctttaaagatgtggctggatgtatcttccggtgccattgactggccagggaatgacgggtgcaggctcatcctgttccggcctgttgatgagaagaataagaatcttttttatcatctgacagacaacaccgtttatgatgaattgtttgaattgaatattgctgcaaatgcctacaaggtcctgttttatcagcaggataagttcagggttccgaggacagaaggacggctggattccatgtgcatggaggcggcggaccttataatccacccggaagacaggacgagatttttagaattctgggaagcctccactctgctggaccggcttcacgccaacggaaggattatgaaaggggaattccgtaagctgcttgtcaatggaaactattgctgggccagagtgatcgcagttttgttccggtgcggggactgcgcagacccaattattatgtgctatgtccaggacattgacagcaggaagaaaaaggaagaggaagagcagaaaaggcttcaggagaagagggaagaaacagattccatgacaggacttttccgctacggccctttttttgagaaggcagaacagcttctggagaagagtccaaatgcaaagtatgttatggtggctattgatattgaacattttaagctttttaacgaatggtacggggaagaggaaggggaccgcttcctcatcaagatcggaaagcatttgaaatccgtggagctgctgtatgactccattgcaggatatatgggaggtgatgattttgtcattatccttccggaggatatttccatactgaagaacctggaaaaggagatcaataattatgtcaggcagtatggggcaaatgcgggatttcttccggctttcggaatctaccggatcgaggaccgcagcctttcggtcagcatgatgtatgacagggcagcgatcgcattaaattccgtaaagggcaattatgccaggcgcataggctggtatgatccgggcatgaagcaaaagatggaaaaggatcagctgcttctctcggagatccagcgggctctggaaaaaagagagtttattttttacgtccagccccagtgcaatatgcttaccggaaagatcattggtctggaatccttagtcagatggcagcaccccctccggggacttatttctcccggagagtttatccctttactggaacagaacgggtttatcacttatctggatatttatatctgggagatggtatgcaggcagctgagcgcctggatcaaggaaggaaagaagctgatccctttttcggtgaacatgtcccgcatggatatctatgccattgatgtggtggaaaaattcaaggaactggtgagtaaatacgggattgaccccaaatacctggaaattgagatcacggaaagcgcttatgcggaggatgacgataagatccggagagttctggaagatttacgcaaggcgggctttccggttttcatggatgactttggaagcggttattcttcccttaacatgcttaaggatgtcaatgtggatgtgattaagatcgataccaaatttctggatatgaatgaaaacagccagagccgcggaatgggaattctggagaccatcgtaagaatggcaagggtcatgcagatgaagatcattgccgaaggggttgaaagaaaggaacaggtggactttttaaggagcatcggctgcatttacggacagggatattattattacaagcctcttccggtgaaagaggcagagcttcttttaatgcaggagggaaatgtggattacagcggaatccagacccggccgcccggtcagctgaagcttgaggatctgtttaatgagaacatcaccagcgaagccatgttaaataacatgctgggggccatcgccttgtacgaggtgtatgaggaccggtgtgaggtgcttcgtgtaaaccaggaatattaccgcatcacaggtgataatccggctgatatggaagaacgcagatggtttcttctgaacaaggtatataaagatgacagggactgggtcctgaatatttttgaaaatgcatacagcaatcccctccggggaggagagggtattttccggcagtaccgaccgggcggtgaactgatgtgggtacatctgcgggtgttctttttaagagagcaggatgagcgccgcctgtactatggatcgatgagagatgccacagagcagatggagcagcgtcagaagctgaaggattcccagaaaatcctgggagatgtattaaggctttccggcagaaacctttcctttgaaaacattgcccaggaaaatgagtgggcagccggtgccatatttgcccagatagctccaggcgtgctccttggtgtttactgtgaaaaggggctgcccttgtattttgtaaacaatgagctgctccgtcttctggaatatgatacttacgaggtgttttcaagggcagtggaaggaaagatcgcaaatctcattcacccggaggatttaaagcggatacaggaatctattttccgctatatatccccgggcatggaatatgccttccgtcaccgcataaaaaagcgggatgggagctggctgtgggtcatgacaaaaagccgtgtggtccaggctgaagatggaaggctggcagttgtgaacgtttgtatggatatcagtgacactcttttgacacagaaaaagctgcaggataccaatgaggtccttcaattaaaaaatgatgaactggaatttttaggctccggaatgccgggagggtatttccggtgtaaaagatcggaacatatggagctgatttataccagcctccgttttctggaaattgtggattattcaaaagaggaattggaagaacggtttggcaatcagtttatggccatgatccatccggaagaccgtgaaaaggtctatgagcttacgacggccttaaagccggaggaaaacttaagaggtgtggaattccgggttctttcaaagaatggttatatctggattttatgccattccaagctgtcggtgaaagcagacggaagctttttatacggagtgatgcttcacatcgatgagatcgtggagctgcgcaggcagatcgaatgcagcaggaagatgttaaatcagatggagcgcatgacattgggagtgtctgattccataaagggacttcctgaccgtgaggctgccgcttccatggtggaggcttatctggtccgccgccgtttccagccttcggctctgatcctgtttgaaatttggggaccggaaggggaagatgaggaaagctgtaaggcgggaatgccgttttttgcatcctatatggaatgtctgaaacattttttcagggaagatgatatcatctgcttaagcggcgtatatgaggcaatggtgctgtgcaaaaatatccggaaaaatgatatggaaaataagctgaagcgggtgacaggggctttgtcccgggaactcgcaggagaagacggagaggtccggtaccggatcaacgccgcctttgttatgatagaggtacaggataaggatttttcagtctgctgcgacaaggtcagagaagctcttttggaagcaaggcaggtttctaaagagagaagtgtgaaatacgaatagaccgcttccggcacttgtgatataatcctcataaaactgtttcaggatgaaggatgcttacaggcataccacaatgcccaaaaaatgtgggcaataacaaggaaagggataaaattatgatagcagacaagatgagaccccttgtaaagaacaattccgccattcgtgccatgtttgaggaaggaaagaagatggctgcagtgtatggcagggaaaatgtctatgatttcagccttggtaatcccaatgtgccggcccctccggcggtgaaccaggccattctggacattatcagggaagaggaaaccactttaatccatggatacatgagcaacgcaggatttgaagagacaagagccgcggtcgcccagtccttaaacaggcggtttggaactcattttcgtctggaaaatattcttatgaccgttggagctgccagcgggatgaacgtaatattaaaaacaatactggatcccggcgatgaggtgctggtgtttgcaccttattttatggaatacggttcttatgtccggaattacgacggcgtgcttgcggtggtgcctccggatcaatccagttttcagcctgatttagaggaatttgaaaagaggatcactcctaagacaaaggcagtgatcatcaacacccccaataatcctacaggagtggtctattccgcggagactctgcacaaaatcgcagctatccttttaaaaaaggaagaggagcttggaatccagatcctgctgatttctgatgaaccttaccgggagctggcctatgatgggatagaagtaccctatgtcaccccgttttaccacaataccgttgtctgctattcctacagtaaatccttatccctgcctggagaacggatcggatatctggtgattcctgatgaggtggaggattccggaaaggtcatagctgccgctgccattgcaaaccgtgtgcttggctgcgtcaatgccccttctctcatgcagcgggtgatcgtgcgctgtgtggatgaacaggtaaacctggaagcatataacaggaacagggagcttctttacggcagtttaaaggaatatggttttgaatgcatcaaaccggaaggagccttttatttatttgtgaaggctccggcagatgataaggaattctgtcaggcctgcaaggcgcaccgggtgcttttggtccctggaacctcctttgcatgtccgggatatgtgaggatcgcctattgcgtgtcctatgagcagatccagcgctctttgcctgcatttaagcaaattgcggaagagtacggccttacaggaaaaagggaggaaaagcaatgagaccatgggaagccaacatcagaagggttgccccctatgtgccgggagagcagccaaagggagaaaagttagttaagttaaataccaatgaaaacccatatccgccggctcccggcgttcagcaggcattggatcagatggactgtgacctgttccgcaaatatccggatccggctgcaacggtcctgattaaggccctttcaaaagcttatcaggtggatgaggacagaatctttgtgggagttggctctgatgatgtgatcgcagtcgcttttatgaccttttttaattccagtaaacccctactgtttcctgatgtgagctattccttttacaaggtctgggcggatttattcaggattccatatgaaactcctgcacttgacgaagaatttcgtatcaggaaggaagattattacagggaaaatgggggaatcatatttccaaaccccaatgcacctaccggccttcttatgtctctttcccaggtagaagatatcatagctcataaccaggagtctgtggtgatcgtagatgaagcttacattgatttcggcggggaaagtgccataagcctgactgaaaaatacgaaaatcttctggtggttcagaccttcagcaaatcacgctccatggctggaatgagaatcggctgcgctttcggccatccggacttaatcagcaggctgaacgatgtaaagtattcctttaattcctacaccatgaacatcccttccctgattttaggtgcaaaagcacttgaggatggcagatattttaaggagacccttgaaaagatcataaacacaagagaatatgccaagaaacggcttggagaactgggattttcattcccggattccatggcaaactttatctttgcatctcataaggaccgaaaggcagaggagatttataaggctctccgggaaaacaatatttttgtccggtactttaagctgccaaggatagacaatcacttgcgcatttccataggacggatgaggagatggagaagctttacggttttttgaaagaatatctttagaatttattcatttgtcaggaaggcctttggggagtatcatataagcaggtgattaaaatggaacaagttaaaaaatattgcagactgtttctcaatattgttataccgattttatttttatatttaatttgcgtgtgggggccaaggcttttaaatttcttcctcccctttgtcatcggctggatcattgcggtcattgcaaatcctttggtgcgttttctggaaaagcgtttgaagatcgtaaggaagcacagctccgtgatgattgtggtggcagtactggcccttattataactgtgctttatttcctgatctctaagctgattgccgaagcggcaggttttgcaggagatattccaaagtattatgagtccgcctggatcgagatccagaagctgctattgcaggtggaagggcttttgcagtttctgcctgagaacattcaggtgtccgtaaaccagttttttacccatataggcgaatatttaaatgtaatggtccagaaaattgcttctcctacggtgaccgtggcgggaaatgtggtaaagagcattccggctgctttggtttataccattgtgacgattttttcctcctacttatttattgtggacagggataagatcatggaagtggttcaccggtacatccccaatgggggaccaagtattttcagtatttaaaaaaggacgcaaagcgtctggtgggcggttacttccttgcccagttcaagatcatgttcattattgccgcagtattggcagccggatttctggtactgggagtgaattatgccctgcttcttgcagttatcatagcaattcttgactttcttccgatattggggaccggcaccattctgatcccatgggctgtcatccgccttgttgcaggtgaatatgcctttggctttggcctggtgatcatctatgttctgactttggtgttaaggcaggtcatccagcccaagatcgtaggcgacaccatgggcctggatcctcttatgacactgctgtttttataccttggatttaaaataagcgggatcgccggcatgattttagcggtgcccattggcatgctgtttttaaatttatatgaattcggagcctttgattcctttattgacagcgtgaaaacattgattcatgatattaatgacttccgcaaaagacgggactaatttggttcagccattgatggcgggaaagaggagaatatgaaaaagaatacaaaactgagagtggctttatgccttgtagccggtctcatgactttaaaagccacggcagcgcctgccaccgggttttctgcggaggcgtggaaactggaaaacggacaatatgtggatgcctccggcagccccattgcaggagcgctggcaaagggaattacggtaacaaagtatcagaaccgccagaatgcggaaaacggagggatcgactggaagaaggtggctcaggacggagtgtcctttgccatggtacgcatcggatatctcaatgacagggatccctattactccataaatatggagggcgcagcggcaggcgggctaaagaccggagtatttttttatacccaggcccttgatacccagactgcagtggaggaagccaaatatgtgcttcggatggtaaaggattacccgatttcctatcccatcgcatatgatgtggaatcccagcaccttcttgacaatcatttatcaaagcagcagattacggataatatcaatgcattctgcaagaccatttccgatgcaggataccgtccaatcgtctatgccaataacaaatggctgtccaattacattgatattgaacagatcccatatgatgtatggtatgccagatacggaaccgtcaacaattataagaaccgtaccatttggcagtgtacggaccagggaagagtggatgggatcgacggagacgtgaccattgaactttcctttgcagattacggcgctctgatcccttcggaagggtggaaaaccattgacggaaataaatattatacaaagaattatgtaaaacagaccggctgggtccaggtgggagacatctggtattatctggattccaatggcatcatggttcatgataccgccatggatattgacggagtttcctatacctttggctctgacggagccatggtccagtgaccggattaacggagttttgacgtgaagacagaaaataatttagatacggatcaaatcaggggcctggtatggaggctggcaattccctccatgctggcccagtttgtcagtgttttttacagcattgtagaccggatgtacataggaaacatcgcaggaacaggggagatcgcattggcaggggtaggaatctgcggccctattgtgaccatgatctcttctgtagcatttttagtgggtgtgggagggtctcctttaatgagcatccgcttgggagagaaaaaccagagggcggccagccagatactggcaaactgttttatgctcttaacaatcttatcggtggtgatcactgttatttcctttatggtaaaagaaaagcttttgatgtggtttggtgccagcgaggccgcatttccttatgccaatgattacattaccatatgcctgctgggcaccgtctttgcgcttttgtccacagggatgaatcagttcatcatctgccagggatttgcaaagaccggaatgaagtcagtgcttctgggggccgtatgcaatatcgtgctggacccggtgtttatgtttgtttttggcctgggagtccggggagcagcgatcgccacagtgctgtctcagatggcttcctgcgcttatgtgcttaagttcctgtttggagacaagccgcccatccggatcaccttcggcaattatgactggcaggtcatgaaacgtgtcctgatgctgggcctaagcccatttctcatcattgcatttgataatgttttaataatatccttaaatatggtgatccggcgttacggcggagagagccagggagacatgcttcttacctgcatgaccattgtacagagctttatgctcatggtcaccatgcctcttggagggatcaccggagggacccagaccatacttggttataatttcggagcgggaaggcctgaccggatcaaaaaggcaggcttttatatttcaggtctggcccttgggtttaccaccattatgtttattctggctcatacggttccccattactttgtccgcatttttacccagaatgaggcttatgtggaactgacggtgtgggccattaagatatacaccatgggtatcatacctcttgcgctgcagtatgcggttgtagacgggtttgtgggaatgggagtcgcaaaggtggccatttccctttccatgttccggaaggtgatatttttagggggtgcagtccttattccggtgtggtttgggatagaaaagatattttatacggagccggtttcggattttatcagtgttgtggtgtcgctgaccgtgactttattaacctttgaacaggtcataaagggaagcggaaagccggcctttgacccaaaagttcgctgcggccatcatgggaaaatagttcattgagcccttaagaaagaccggggagcggacggaatttaaagattccgtccgctccccggtctttttgctaggtttaagaaccggttgactgataacgggacagtccgaagttccataaaagtccggcagggacaagaaagaaacaggcggccagaggaagaaggctgtaccatggattggaggttctgcctgtgagatataaaaagggataatactgaaacagggcaaatggaaccaggtaggtacagattgtcaaaagggtttttccataaatgccgatgggatattttccatactctctggctccgtcagtgaacacattcatgaattccaggccttccagggtaaaaaagcatatggaggcaaagattaagtaaatggctgcaaataccgccacaccgcctgtgaccatgaggacgacagtaaaggcccggacagggttccagtcaatggaactgaaccgcaggccgtatacgagcatgactgcagcctgcaaaagccgtccgatcctggttaaatcgatcttgctgcacaggaccagaaacagacagtttctgggttttaagaggattcggtcaaattctccgttgcctatgatggtctcaaaggtgtccaggctccggaagatggcctcagctatggtaaaagccatgagcgtaatggaaaaacaaaggagaacctccccataggaaaatccctttacttccttaaaacggtccatcataaaaaggactccaagaaatatgttaaaggatattaaaaactgccctatgatggttaaaaagaaggaggttttatgctgcatcatgctctttaaatgcatgagcagatatttttcgtataaccggatggaattcatgttatgcctcctttcaaccgccctggaacacaacgcgttttaaagcattgcgttccatgatccgtccaatgatgagaaacatcgccagccagaatacctgtacgaaaaggcttgcatacatgtcctgcccttttaaatcaccgccgaagatccggaaggggacattctgggccgaggcaaagggcagaaggttcacaaactccctgattccgtcaggcagaaatggaagagggatgaccgagccgcttaaaaactccgaaagggaggtgacgatcagcttgatcccctgggaggaaatggtgtaaaaaacagacatatacacgatcatgccaaaggcaaccacaaaaagaaaccccagggtcatggacaaaagggtgaaaaaccatgtatgaaagcttcctggaagagcaaggccgtaaggggccggcagaagccaggcaaagagcagaatgggcatgcaccgaaggactgctttggaaaggcggacggccagacctctggcaaaccacatgttgtaaaggcggacagggcggcatagttcataggccacgtttcctgttgtaatggaatcaaacagctcagactcccagaaccaggtcatgtaaagggccagaaaggcctgctgaagccatacgtaggtggaaagtgcctgaaattccatgggaaagctttcaggagcagcttcataaaatgcccggaataaaaggatctccatggttccccatacaaactgggtgaccatgccggaaagggctgccgcacggtattgaagcccatggataaaacggatgcggaaaaaggaccagtattttttcatggcttctcctcctatatccggtaatcccggtaaagggcggcaatgatctcatccagtgtggcatcttccctgggacggtgggattttaagtccgaaagagcgccgtctaaaagcagccgtccttttccgatcaggaggaccctgtctgccagagcatcgatgtcctgcatatcatgggtggtaagaaggacagtggttttgtgcttatggttctgctttcggatgaagtcccggactgcaagcttggatactgcatctaggccaatggttggttcatccagaaacaggatctttggtctgtggagaagggaagcagcaatctcgcagcgcatccgctggcctaaagataagttcctggccggtgtgcgcaaaagctctcccagggacaaaagttctgtcagctcgtccagggtttcctggtattggtttgtggggatttcgtagatgtcgcggagcagttcaaaggaatccagaatggggacatcccaccaaagctgggtgcgctggccgaagacaacgccaatatcctttacatgtgccttgcgttccttccatgggacccggccattgatcaggcaggtgccgttatccggtgtaaggattccgcttagaattttgatggtggagctttttcctgcgccgttggggccgatatagcctaccatttctccgtctcctatgataaaggagatgtcggaaagggcgtggatggtttccacctctttgcgaaaaagggccttgactgcttttgaaaagccggcacttcttcttgcgaccttgaaggtcttgttcatgtgttccacttgaatcataaaagttcctcctggtagtaatatttgtgaacccgttctttccggcagcggacagttctttcgtaagaaagaaatctgtcataactggtcagaggatcccaatatcttgccaagcggtgagcgccattcggtaaaccgatggaaacgctgctctccggaatcagaaaatttctctttccggggactctaccgtggtatcaatattctcttttcctgaatgtgagatgtgaaattagaatggaaaaggaatttaagtctaccaccactggggcaggctgtcaagtgaacaaaaaagcggttgacattttatgaaaaagtgataatataaacatatgaacaattattcatataataatggtgagattaaggaggtacccaatggagcaggacagcaaaagaaatattcaggactgtgaaatcgaccagtgcgattttatctgtgttcatgaaactgttgtaagtcaggtgctaaaggccatgccccaggatcaggagcttcttgatctggcagatttcttcaaaatatttggtgatgctaccaggataaagatcctctatgtactaagccagtcagagatgtgtgtatgtgatattgcaaatcttttaaaaatgggtcagtcagctatttcccaccagctccgggtgctgaagcagatgcgcctggtgaagttccgcagagagggaaagaccgtattttattccctggctgacggccacatcgagaccatcctggctcaggggatggagcatatcaatgagtgatgaagacaggaataaaaaataaaaaaggagagaaactgttatgaagaagattgtcaagctggaaggcttgtgctgcgccaactgtgcggccaggattgaagaagaggtaaagaaattagatggtgtggaaagcgcgtccgtaagctttatgacccagaggatgaccatggaaatcgaagacggcaagtcggttgaaatcatggaagcagccaaaaagatctcatacaagattgagcctgaagcagaatttaaggtgcttcggtaaggcaggggagcagcgatgacaaagaaacagaaacggatggcaatcaggcttgcggccagcgccctgttttttgcagcaggaatggttggggaggaaaaaacagtctggtactggctgttctttttgatctcctatcttgcggcagggtatgacattcctttaagggcaatccggaacattaaaaacggccagtttttcgacgaaaattttctcatgtcagtggcgacctttggtgccatcggtatcggagctatggaagaagcggtgggagtcatgctgttttaccagatcggtgaactctttaatgactacgcggtaaacaaatcaagaaagtccatcacagagcttatggatatcaatccggaatatgccaatcttcttaaggatgggaaggaagaaaaagtggacccttacgaggtttcagtaggggataccatcgtaataaaaccgggagaaaaggtacctcttgacggcgttgtcataaagggtaccggagggctggatacaaaggccctgacaggagaatccatgcctgtggaagtgaaggaaaacgatgccgtactcagcggttccattaatttaaacggtgttttggaggtcagggtaacaaagctgtttgatgactccacggtggcaaagatcctggagctggtggaaaatgccagctttagaaaagcaaaggccgagaacttcatcaccaggtttgcaagggtttatacgccggttgtggtggctctggcactcatcctggcattgattcctcctttggtgtttggcggcgggtggggaacctggatttaccgtgcctgcagctttctggtggtttcctgtccctgtgctctggtgatttccgttcccttaagctttttcggagggctgggcgctgcttccagaaatgggatccttatgaagggaagcaattacttagaagccatggcctccttggaaacagttgtctttgacaaaacaggcactcttacaacaggaaaattccgggtcacaaacgtggatcctgcagaaggaactgaggaagagcttttaaggctggctgcatatggagagttccattccaatcatcccatcgctttgtcggtaaaggaagcttatggaaagcctgttgatgagacactcatcggcagggtggaagagatagcaggacacggcattaaggcagagcttaatgaagaagggaaggaacaggagctttatatcggcaatgcaaggcttatggaacagcaggggatcacggtcccggcccaggagtctgtaacaggaacctctctttatgtggctgaggccgggcggtatctgggttccatcaccatttctgacaccatacgggatgacgtgccaatggcattaaaaggattaaaggaggcaggagtcaggaagctggtgatgctgacaggtgataagccggaagttggccgcgcggttggtgaaaagctggggcttgacgaggttcacggcggccttcttcccggtgataaggtaggaaaggtagaggaactgctgtcaaggaaacgggaagggatgaatctggcctttgtaggtgacggcatcaatgatgccccggtccttgcccgtgccgatgttggaatcgccatgggcggaatcggctctgatgcggcggtagaagccgctgatgtggtgatcatgacggatgaaccctcaaagcttatagacgccatcgcaattgccaggaaaacagcggtcattgtgaagcagaatatcgttttcgccattggagtaaaggtgctcattcttatattgtcggccgctggaatggcaacgatgtgggcagccgtatttggagatgtaggggtttcggtacttgccattttaaatgccatcagggctttggcttatcaaagtaataaataaaaatattgacaaattttttcccagctgttatattttacacatatgacggggtggtgcgaagatggtccattgatgtgagactgtgtttgcctgcccctttttttgctattacagaaaagctggggcttttcattttagagtttaagaagggagacagcattatgagcaagtacagcaaagaagatatattccggatcgtagaggaagaagacgtggaatttatccgccttcagtttacagatattttcggtatgctgaaaaatgttgcgatcaccaaaagcatgcttggcaaggcactggagaaccgctgcatgtttgacggttctgccattgagggttttgtgagaatggaagagtctgacatgtacctttatccggatcttgatacctttgagatatttccatggcgtccacagcaggggaaggttgcccgcctgatgtgcgacgtatactgcccggacaggatgccgtttgacggcgatcccagattcgtgcttaaaaaagtgctgaagaaagcaagggacatgggatttgaattccatgcagggccggaatgtgaattcttccttttccatacggatgaagaggggcgtcccacaacggaaacccatgagacagccagctattttgatgtggctcccattgatctggccgagaatgtccgccgggatatggtgctgaatctggaagaaatgggatttatgatcgaggcttcccatcatgagatttctcctgggcagcatgaaatcgattttcagtatgcagagggcatggtgacagcagataacatcatgacctttaaaatggccgtaaagtccattgccaagcgccacggacttcatgctacctttatgccaaaaccaaaggcaggagtcaacggttccggaatgcacatcaatatgtccctgtctgatttaaaaggcaataacatgtttgaggacgcatccgataagctgggcttaagcaagactgcctatcagtttatagcaggaatcctttatcacatgaaagggatggcaatactaactaatcccttggtcaattcctataaacgccttgtccccggatatgacgctccggtttatattgcatggtcagccagggcaaacagaagctctctgatccgcatcccttcctccagaggagcgggaaccaggattgagcttcgctgtccggacccggccgtcaacccttatttggctctggctgcctgcctggctgccggtcttgacgggatcgaaaaagggcttactccgccggaaagcgttgatcagaacatttttgccatgcagccggaggagattttgaaaaaaggcattgagcgcctgccggaaaccctgggagaggccattgaggacttccggaaggacgattttatgaaagaagtgctgggcgaacatatctataccaagtacctggaagcaaaggaaaccgaatggcacctgttccgggcccaggtaacggattgggaagtggaagaatacctgtataagtattgatgatttctgttttctgatacgattatctggaggtgagagtgtttgaccaatgtgatagtggcattttccagagaagaggatgcaaaaaatattaaaaatattcttatgaggaacggctttacggtatcagcggtctgcacctccggtgcacaggcggtaaacagcgccgacgagctgggcagtggaatcgtagtatgcggatacaggtttgcggatatggtgtttcatgagctttatgaatgccttccggagggcatgcagatgcttcttttagtgtccccagccagtggagcggcagggcgcctgagggtgtggtctgcctgggccatcccttaaaggtacaggatctggtaagcactctggaaatgatgatggaatctcttgccagaaggcgtaagaaattaaaaagccagccaaaagagcggagcaaggaagaaatagaaatgatcagacaggcaaaagagcttttgatggagcggaaccacatgtccgaaacggatgcccaccggtacatccagaaatgcagcatggacagcggaaccaatatggtggaaactgcccagatgatcatgagcctgatcaatcgatagttgtgggagagaacgatgaaatttacaaaaatgcagggaatcggaaacgattacgtttatatcaattgttttgaggaatctgtggaagctccggccgagcttgccaaaaaggtcagcgaccggcactttggcattggatccgatggactgatcctcatctgtccgtcagagacagcggactgccaaatgcggatgtttaacgccgacggctcggagagccagatgtgcggcaacggcatccgctgtgtgggaaagtatgtttacgatcaccgcctggtggaaaaaacggaatttgacgtggagacgggagcagggatcaaacatttaaaggtaaaacaggagaatggaaaggctgtccagatcacagtggacatgggagtgccggagatcaccagccaggtgccggagccgatactggtcgatggaaagagctatgagttcatcggcatttccatgggaaacccccatgccgtttactacctggataacattgactgtctggatttagaggccattggacctgcttttgaaaaccatgagcgttttccggaacggaccaattcagaatttattcaggtggtgaaccgggattatatccgcatgagggtatgggagagaggcagcggggaaacttatgcctgcgggacaggagccactgccagtgcggtcgcctctgccttaagcggccgtaccggccaaaccgttcaagtggaactaaagggcggtaatctgaccattcactgggaccgggaaggaagcggacatgtgttcatgaccggaccggcggtggaagtgtttgaaggtgaatttaacataaaaaatctttaaagtaacaggaggaacccatggtaaaaatcaatgaaaattacttaaagcttccaggaagctatcttttttccaccattgggaaaaaggtaaacgcctatactgaggcaaatccggataagaggatcatccgtctgggaatcggtgatgtgacccagcccattgcgccggccattattaatgcgcttcatgaagcggtggatgagatgggctgtaaggagacctttcatggctatgcgccggatctgggctatggatttttaagagaaatcattgcaaaggaagattacacagccagaggctgtgagatatcccctgatgaaatctttatttcggacggcgctaagagtgattgcggaaatatccaggagatctttgacgaaagctgtaaaattgcagtctgcgacccggtttatccggtttatgtggattccaatgccatggcaggaagaaccggggaatacgaggaagaagccggtaagtggagcaatgttatttatatgccatgtacggctgaaaatcattttgtaccggagcttccaaacgagacgccggatcttatttacttatgtgttccgggcaatcctacgggaaccaccctcaccagggaccagttaaaggtatgggtggattatgccaataacaagggggctgtgatcctttatgacgctgcctatgaagcctacattgcccaggatgacgtgcctcattccatctatgagatcaagggcgccgaaacctgtgccattgagtttcgttccttttcaaaaaatgcaggttttaccggcgtgcgcctgggctttaccgtcattccaaaagtcctggtaaggggaggggtctctcttcactccctatgggccagacgccatggaactaaatttaacggagcgccctatattgtccagaaggccggagctgcggtttattctgaggaaggaaaggcccagttaaaggaacaggtggcttattacatgagaaatgcgaaaaccatctacaccgggctgaaggaagccggctgtgaggtttacggcggcgtcaatgcgccttatatctggttaaaggtaccggcaggaatgacctcctgggagttttttgacagccttcttgtggaagccggcgtggtgggaactcctggaagcggatttggaccaagcggtgagggatacttccgtttaacggcatttggaacctatgagaacaccgtagaagccatggaacggatgaaaaaaatgccgtgccttaaaaaataaacattgacaagcatataatgattggttatgataaatctatgaaagattcataagcgtgcagttttaattgaaagaacaaaagcgttcagtgccttagcggtgctggcgcttttcttctttccgggaggaaaaaatggatgacatcgatagaaaaatagtgaagacattacaaaagaatgccagagaatccttaaaaaacatagcagaaaccacttttctgtcttctcccgcagtttcttccagaattgaaaagctggagcgggaaagaatcatcactggctaccatgcagcagtggattcaaggaagctgggataccatatcacagcatttgtaagccttgaagttccaccggcggataagatccagttctatgaggatatgaagtccatacccaatgtgctggagtgcaactgcgttacaggagaatactccatgctggtgaaagtagcttttccaagtaccatggagctggacgtttttatcgggcggcttcagaaatacggaaagaccagcactcagatagtattttccactccggtagggccaagagacgtggatgtgatggcggaattaggagaaaaagaataaatatggtacgaaaaaatggtaccgagaaggcttcctttacatactttatataatagaagtatgtgaagggagtttttcttttggctgagagaatgatcgtagtaatagatgccggtcatggcggcgcggatccaggtgcgtcctatggcggacggaaagaaaaagatgataacttaaagcttgcgatggctgtgggaagaattcttgcagacaacggagttgacgtcagatataccagaactgacgatacctacaatacgccccttgagaaggccatgatggccaatgatgcggaagcagatttatttgtttccctccaccgcaatgccatgccggttccaggcaccggttccggaatagaagttcttgtatttgaagataaaggggtgccgggcatgctggccaaaaacataggagaagccttaaatgaagccggatttgtcaatttaggcacagtagaacgtccgggcctggtaattctcaggcggacaaagataccatcggttatggtggaagtaggatttattgacaacgaagaggataataacttatttgatgagaacttccaggctgtggcccaggccattgcagatggcgtcctaaattccataaaggaacaggaggagacacgtcccgaatattatcaggtgcaggtaggggcataccgggtccatactctggcagaagatcaggtcatcactttaaaggcgcagggtttcccggcctttgttgtctatgaagacggattatataaggtccgtgtgggagcattccgcaatctcgataatgcggtgcgcatggagcagactctcagaaagtgcggatatagcacgtttatggtaaaaagaccggctgtgttttaagcccaaggctgctttgttgctttgcatctggccgccgggacgcaggctttttgaaagaagtcacgcccctgcggcttttttctgctgccagaaaacagacgtaaccaggggaaaggtgtattagaagcggtcaggagggcataggatataccatatatatttaattcaggaggaattgcttggaatatatcagtgagcttttaaagggtgttatcattggcgtggcaaacatacttcccggcatcagcgggggaatgctggctattaccatgggagtgtacgataagatcattcatgcggtgacgcagcttttccgggaacctttaaaaagcctgcgggttctcctcccttatggggtaggggcggttgcaggcattatctttctgtctctggcatttgaataccttttccatacatatccgctccaaaccaaaatggcatttttgggattgatcggcggcggacttccttccctttttcaaaaatcgtttacaaaagaccggacagacagaaaaaaaggcatattaacggcagcccttacctgctgcgcggtcattctcattacctttattgccgaaacaaccattacctccggccatagcggagagggaatgaacatggcttccggtgcggcttatctttcttccggaaggctctggatgttcacgctgtttatggtgggtctgctggctgcagccaccatggtggttccgggagtgagcggatccatgatcatgatgatgataggctattatgaacccatactgcagacgaacaatgcctgcataagggctctctcatcttttgacctccaaagcctttggataaacgggctggtgctggcgccctatgtgtcgggtcttttgatcggtgtgtttctctttgcaaaagtggtggaacgccttctcacccgccatgagcgccaaatgtaccgggtcatcataggcctggtgttttcctctccctttgtcatcttatgggatatgcagtggggagaggtgaagctgtatgagctgcttgggggattgctctggctttgctgggatatgtggcggccgatttactggggggagaaggttaagatagaaaaaggaagaaggccctttccatggggcctttttccttgcactgaccgaatgcattgcattgtaaaattatttattttattatatcagaaataaggttaaaaatatagcactgaatggttattatcatcattcagtgctatacttaaaatgacatatcatcatgggtctgtaagaccctgctttttaagagtactctgcgatccgtgtgatccccacataaatatgggaaatcctgtaccaggtggcaaaatcaatgatgccggttacaggaagcccgaaaatggactggaattgccggactgcttcggcggttgccgggccaaagattccgtcggccctgatgcgtggaatggcggtatagacggtagcgattgtatcaagctgttcctgaacctggcggaccttatcaccgctggctccgatggtcaggttataacctggccaggaggaaggaaccccggatacctgttctgcggtgttgatgtacatatcacttccataataataacgcagtatttcaatggcggaatagccctgttctccaagggtgcagcttccccactgggacatccagttaggacactggaccctgttgccgtcacagtattgggtgaggatgggctgtctgatgcctggacgggacaagtagctgttaaagatctcatccaccacctgggaaatgctttcgtagatgttccgcccatagatccatttatggtcaaaggccgtggaggaggtgatggtaaaatcatatccctggttccggtaccactccgtatagacacggtttaaagtaaagctcatgatagcaagaacattggcggtgatggcggacctgggccatgtggcgtaaatttcgctggatgccacgtttttaatgtaatctaagtaggggacgtaataattggtagctgtcggatcggtagggactccgtcgtggacgatgatcgtctggggaaccactacccggcttaaaacgatttctcctgattcagctatgggttttacctcagcttccgcgattttgggaggatactctccgtataaggtatggtccgggatgacgatgggaacatccggccctacttcatcctggacaggagtcatgcgcaccggctgaatggccgtggaatctgccaggatctccgtgccggagatggccacaggttcaaagccctgggctatgacggtaagtatgtattccgagtagggttgataaaggcccggtgataagctgtagtcaactggaggtgcggcaagctggacctgctccgtctgaccggatgagttggtggtaagacgttccaccgtgctttcagggtcccccttgtaggcaatggaaacctctgcatcccggatggggaaattattttcctgggaaactacatctacctgaagcgcgccggaagcagtcgtttgctgtgccataaccgtcgtgaattttttcatagaatgccccttaatgaattaattattattaaatatattaagagggaaaaggaataattacaaaagccccgcagggaaagataaaatttaatcctgcgggaagctttttagaaaaaggatgattttgtttcttgaaacatggactccacatagttacgcatttcatcccggctttcaacggatcttgctccgtttacaatcctgtttctctgttcttccggaagttcggcgaaccgggtcagaatatccgagtgctgcgctaactccatggtaaagccgatgggcagttcgctgttatcaatcataatttatcacctcaatcatagtttgtgcggattgtgcagaaagtatacttttgaaaaatcaaccatagattttgcattattatgcatgattttttaataaaataataaaatatgcaggatttataagaaaatataaaaaaatatataagaagaaaacagttgaaaaatgtcgcagcatcatgtataatctatacaatttgggcattcagttcagccgtacatatccacctttcagaaatatatttgatttgctgaattatgaatagcatggctgaacggtagtatttgggcaggctcaacaaccatagcattaagaaaggacagggactttgcttatgaaagcttttttaatactggaagacggtactgtgtttacaggatcgagtattggttcaacccaggaagtgatcagtgagatcgtattcaatacttccatgacaggttatttagaagtcctcaccgacccctcctatgcggggcaggcggttgtgatgacttatcccctgattggtaattacggtatttgtcatgaagatatggaatcactaaaaccatggccggatggctacattgtcagagaattatctagaattcccagcaattttagaagcggggatacccttcagcatttcttaaaagaacacaacattccaggtatcagtggtatcgatacaagagccctaacaaaaatcctaagagaaaaaggtacgatgaacggcatgatcacaaccgatgaaggttatgaccttgaagctgtcatttcgcgtatgaaaacatattccgtgaccggtgtggtggagaagaccacctgcagggagaaatacgttctgccaggcccagggaaaaaggtggcacttttggatctgggggcaaagcagaatatcgcccgctccttgcaggagagaggctgtgaagtaacggtttacccagctttgacgaaagcagaagagatcctatcttcctgtccggacggaatcatgctgtccaacggaccgggggatccaaaggagtgcgtggaggtcattgaggaaataaagaaattatatgaatccaatgttccgattttcgccatctgcctgggtcatcagctcatggcccttgctgccggcgctgatactcacaagctgaaatacggccacagaggcggcaaccatccggtgaaggatttggaaaccggacgggtgtatatttcctcccagaaccacggttatgtggtggatgtggacaccatggaccaagcagtggcggttcctgcctttgtcaatgtaaacgacggaaccaatgaaggattaaaatatacaggcaaaaatatattcaccgtgcagtatcatccggaggcctgtcctggtccgcaggattccggctacttatttgaccggtttataaaaatgatggaggtggaaagataatgccgaagaatcaggatattaaaaaggtgctcgttcttggctccggtcccatcgtcatcggccaggcagcagaatttgattacgccggaacacaggcctgccgctctttaaaagaagaaggcatagaagtggttcttttaaactccaatccggcgaccatcatgacggataaggacattgcagataaggtttatatagaacccttgaccgtagaggtggtggaacagcttatcctaaaggaaaggcctgacagcgtcctgccaacccttggaggccaggctggcttaaaccttgccatggaactggatgataaggggtttttaaaggagcacaaggtgcgcctcatcggaaccacggcccttaccattaaaaaggcagaggaccgggagctgtttaaagagaccatggaaaaaatcggtgagccggtggctccctctgatattgtggaacatgtggaggatggccttaaggttgccgaggagatcggatatcccgtggtgctccgtcccgcctataccttaggcggctcagggggaggaattgcagaaaatccgggacagtgccgtgagatcctggaaaacgggctccgtttatcccgcgtgggacaggtccttgtggagcgctgtattgcaggctggaaggaaatcgaatacgaggtgatgcgggacggcgcaggcaatgtgatcaccgtatgtaatatggaaaacatcgatcctgtaggagttcataccggggacagcattgtggtggctccttcccagaccttgggagataaggagtaccagatgcttcgcacctctgcccttaagatcatcagcgagcttgggatcaccggaggctgcaacgtccagtatgctcttcacccggaaagctttgagtactgtgtgatcgaggtaaatccccgtgtcagccgttcctctgccctggcctccaaggccaccggctaccccatagcaaaggttgcggccaagatcgccctgggctacaccctggatgaaataaagaacgcggtgacaaagaagacctatgccagctttgaacccatgctggattactgtgtggtaaagatgccccgccttccctttgataagttcttaagcgcaaagagaaatttaggaacccagatgaaggccaccggcgaggtcatgagcatctgcaccaattttgaaggcggtcttatgaaggctatccgctccctggagcagcatgtggacagcctcatgtcctatgattttacagggcttacggaagaggagctggccgagacccttcacctggtggatgatcgaaggatctgggtcattgcagaggctttaagaagaggcttttcctatgaaaagatccatgatattacaaaaattgatgtgtggttcattgataaactggcaattcttgtggaaatggaggaagcccttaagaaaggacctcttaccccggatctgttaatggaagcaaagcggcttgaatttcctgatacaatcatttccaggctgactaaaattccggcggaagagatccgccggatgagaaaggaaaacggcattgtagcagcgtttaaaatggtggatacctgcgccgccgaatttgccgctgaaaccccttattattattcctgctttggaagcgagaatgaagcggtaaaaaccgagggaagaaaaaaggtgctggttcttggttccggccccatccgcatcggacagggaatcgaatttgacttctgttcggttcacagtacgtggaccttccgcagagaaggatatgaaaccataatagtcaataacaatccggagacagtgagcacggattttgatatcgcggataagctgtattttgagcctcttaccccggaggatgtggaaagcatcgttgatgtggaaaggccggacggggccgtggtccagttcggcggacagacggcaattaaactgacagaagccttaatgaaaatggggattcccattctgggcacatctgcggaggatgtggatgcggctgaggacagggaactgtttgataagattttggaggaatgtcagattccaagacctgcgggccagacggttttcacagcagaggaagccaagaaggcggcaggagagctgggatatccggtattggtaaggccctcctatgttctgggcggacaggggatgcagatagccatctctgatcaggatattgatgaattcattggaatcatcaaccagatcgcgcaggaacaccccattttagtggataaatatatacctggcaaggaaattgaggtggatgcagtttgtgacggaaaggacattctgattccaggcataatggagcatatggaaagggccggcgtccactccggtgatagcatttccatatatccggcccaaagcatcagtgaaaccgtaaaggaaaccctggtggaatatacaaaaaggctttccagagccctgcatgttaagggcatgatcaacattcagttcattgtaagcggggaagaggtgtatgtgattgaggtaaatcccaggtcttcccggaccgtaccttatatcagcaaggtgaccggtgttcccattattccactggctacccaggtcatctgcggacactccgtcagggacctgggatatgagcctgggcttttgcctgaggcagattatattgccgtgaaaatgccggtgttttcctttgaaaagatccgcggcgccgatgtaagccttggaccggagatgaagtccaccggagaatgtttagggatagcaaaaacctttaatgaggctctttataaagcgtttgcaggagccgggatcaagcttccgagacataaaaatatgatcataaccgtgaaggattccgataaagaggagatcattgatattgcaagaaggttccaggaccagggctataagatattttccacctcaggaacggccagagccttaaaggaccatgggataaaggcccttatggtgcgcaagctggaacaggaatcccccaatcttctggacttgatcctgggccatgagatcgatctggtcattgatacgccgacccagggggcggacagaagcagagacggctttgtgatccggagaaatgccatagaaacaggcgtaacggttttaacttccttggatacggcggccgctttggtcaccagcatggagaacagggcaaaagaactgaccttaatcgatattgcacggataaaaaataaataacaaaaaaggctggaacgcagggatatgttccagccttttttgtttattgcatgggggttttaacaaattgtttgtcaaactccgggttataataatagaagtttttcggattcaaattggatttgatcttttcgagagcttcaccaaaccgctggaagtgtaccacttccctttcccggagaaactttaagggttcccttatatcgggatttggtatgatacggattaagttgtcatagacggttctcgctttttgctctgctgccaggtcctcgactaaatcggtaatggcatcgcctttcgactggaattcacaggcattaaaaggaaccccgcctgctgccattggccagagggctgttgtatggtcaatatagtaggcatcaaaccctgctgtctttgcctgctccacagaaagattctttgtcagctggtaaatgatggcgcagatcatttccagatgcccaagctcttccgttccaatatcagttaaaagacctcctacttctttgcatggcatggagtacctttgggaaagataacgcatggaagctgccatctctccatccggtccgccgaactggctgatgatcagggaagctgttttcgggcaggtctccttgatgtttacagggaactgcagtcttttttcataattccacattatacagtacctccttcccagggaagcgggccgtctgtccaggtgaaatgcttttgtcccgcatattttgtctgggtttctgttttgttgtttgtatcaggacagacacagttgatggtgagtggttcaaagttttccgcataggtttttaagagctgttttctttgatccattgcctgcttaaaggctgttaatgcattttcatccaatggatgggtatccagatacagagtcaaatcattaacagtgaaactaacttccgtgatctgctttaaaagagttttttgatccgccattactgatcacctcctgttacatagaaaggaagattaaggcttgggaaaatggttccgtgctttaaggccgtctgaggatcataaggctgttcccagggctgcatgggaatggtggcgatggccagttgaaccgtttttgaaggtgtagcaggacttccatttgatgtgtcacatccacatgaagtacttgaattcataataacactcctttcagtcattcattgagctttcttccttagtatggttgaaatacagcaaaatacgttgcaaaaattctcccattttaaccactgcaatgatattgtaataaatggaaaaatgaaatataatggaaaggcaggaatgaattgacagaataatgaaaataaatgaagacaggagaacagagtattgagcgacaagaaatttgcagtattgattgattcggataatatctccgcaaagtatattacatgtattctggatgagatgacccggtatggagtcattacttacaaaaggatttacggagattggacaagctcccagatgggaaaatggaaaatggagcttcttgaaaattcaatcactccaatccagcaattttccaatactgtaggaaagaatgccaccgattcggccctgatcattgatgccatggacttgctttatacggacaatgtggatggattctgcatcgtatccagcgacagtgatttcacccgcttagccagcaggctccgggagtccggaaaggaagttatcggaatgggagaggataagacacccaaatccttccgggcggcctgtacggtttttactaatctggaggttcttcttaaccaggatgaggaggggacaggcggaggcgcaataggaaaagaggtgattgaacaggatatcacttccatcattctggaaaatgaggacaagaataaggcaaccgggcttggagagatcggcaaccgtcttgtgaagaaatattctgattttgatgtgagaaactacggctacagctccctgtccaaatttttggaggaaatgggcagctttgagcttaaaaagtccaataatgtggtgaccgtgcggatgaaggataaccgtaccaaaaagcaggaactggatgattatgccatctggctggtaaagggcggcggaaagaacggtatggagctggctgccctgggaaatggcatgcaccggaagtttgctgatttcaaagtaaaggattacggatattccaccttctcaaaatttgttcacagcatcggacagctggaagtcagggaaaataaaaataacaataagacggtatacttaaaaaaagaagagtaaatatttggcggcagggaatacgaaatctacgtttcccggccgcctttggtttaccatattcccagaacagcctgaagtaccaggcttactgcagaaattccaaaccagcaggaaaagcctaataaaagaggcctttttcctgaccggatcagcttgaccagatcggtattggtcccaatgcctcccatggccagaacaatgaaaaacttacttaagttctttaaaggatctgtgacctgggccggcagggaaaacactgtcgtgatgatggaagccagcagaaaaaagagtacgaaaaacggaagtactttttggatacttatggctggttccgaaatctctttttcctttttggcccggtaacatgccaaaaacagggtaataggaatgatggcaagggtcctggtcagttttactatggtggcggcttccagggtgttgctcccgtacatgccatcccaggcggaagcagcagctgttacagatgaggtatcgttaattgcagttccggcaaacaggccaaagccttcattggaaaggcccaaagccgtaccaagggcagggaatagaagagctgccgcaatgttgaataaaaagatgacggaaatggactgggcgatctcactgtcatcggcatcaatgacggaagccgttgcggcaatggcggagcctccgcagatggaggagccgacgccgattaaaatggcgtttttgcctggaatccttaatctgcgggaaagaaggaatgcggtcaccagggaggtggtgatggttgccaggataatgggaagggcttccctgcccttttgaagaaccgtggacagattcatggaaaagcctaagagaaccacagcatactgcagaatttttttagaagcaaaggccactccgggacggaaaaaatccttcctttttacaaagggggccatagccatgcctatgagaatagcaaacacagggccgccgatgaccgggaaggcttttcctaaaaaccacgcgggagcggatataaaaaggcagagaagaacgcctggggcgtattttttcatgggtaaaatcctccttgttgatttgaatttattatattggaaaagaataataaaataaaattatttatatttatgaaacaataaaaatatgttatggttaatgaagcaatcaaaaaggagaaaataagttatgctggattttcgggtggatacatttcttgcggtatgccggtacatgaactttacaaaggctgccagtgaacttcacatcactcagcctgcagtatcccatcatattcattacctagaggaaaggtacggggttaagctgtttgaatacaatggaaaaaaggtgggcttaacggaggccggaaaagcatttttatctgctgccacaaccatgaaggcagatgaactgcatttaaagaagatcatgggacagcagtcaggaaaaggcaggagtctggtatttggagccaccatgaccatcggggagtatgtgatgccccaggcgctgatacgtctccttcgtgtttatcctgagacagcggtccggatggtggtgggggataccagggagctgtttgcaaagctcaatgacggggagatcgaatttgccttggtggaggggtttttccagaaaaaggaatatgattttctggtctttgcctcggaaccctttgcagcggtctgcgggccggattacagttttcagcgggctgtaagtaaactggaggacctgcttttggaaagacttttgatcagggagcctggctcagggaccaggtatgtctttgaacgctatctggaaggtaagaatttattgcttcaggatttttcaaatataatggaaatcagcaacatcggggccatgaagcagatggcggcaaaagggcaggggatcgcatttctatatgaagcagctgttaaggaggaattaaacaggggagttttgaaaagaatagaactggaggattttcacctgacccatgactttacatttatctggagaaagggaagtatatatggaacctattatcaggaactgtttgatattctccatggagaataatgcagaaataaaacatttttccaccttgagtttgtgagttaaagggatataccggcagatcctcgttgccctcctgcatagtaaaatggcggaaacccttggaaaataagggccaaacagtggaacaggaaaaaatgaaaaatattgacaaaaaagtgttgacaattaatacaattaatattatactaatgaggcagtcgggaacaagagaaaataaagagctcctgaccaagacaagcactgggatcttagctcagctgggagagcatctgccttacaagcagagggtcacaggttcgagccctgtaggtcccattgataagcaaatttgcttattcataaaattaaatatggcggaatagctcagttggccagagcacacggttcatacccgtggtgtcgagagttcgaatctcccttccgctacttttggagacatctgttttacagcagatgtcttttttttgtgtattcgtgtagaaactcagggacaccccatggaggcaaaagaaaatttatgaaactgttccaattaagctggtggtatgggatacaacattttaaaaaagatgcattgagccttggccgggaaactgtatggagaggcaaagtgcacaaaattaaaaataaatatgatgaaaagtgtaaaaagtgacggagatcatattgacaattgatcataacagtgataatatcagtggtataaacagcagaacaaaggagatatgattatgacaaagagagaacgggtattggcagcgatccagggaaaagaagtggattatgtgcccaccgggttttcgctgcactttccggaaagcgaggcgaaaggggagaagggagttcagtctcatcttgaatttttccgtcagacagatacggatatcatcaagatcatgaatgagaacctggttccggatgcaggggagatcaggactcctgaggactggaataaaatacccacttattccttacatgatggtttcttgaaaagccagattgaaatggcaaagagaatcctggatcaggcagatccggatgcattttcccttggcacacttcacggaatttgtgcatcagccattcaccccattgagggacgttatggctatgagggcgtaagagaattattctgcacccatatcagggagaagaaacagcctgttctggaagcgtttaagagaattgcagatgggatgtgccagctggcagtaaaatataaggagattggactggatggaatttattacgcagcattaggcggagagaagcattacttcactgacgaagaattttcggaaatgatagagccctttgacaaggagatattaaaagcttccaaagaagccggaggtatgaactttcttcatatgtgtaaaaataatttaaacatgaagaggtacgaatcctttaacagcctggctgatgtggtaaactggggaatttatgagactgatttcagtcttgatgaagggaagaggcttttccagggcacaaccgtcatgggcgggcttgccaacagaagcggtgttatggtagaagggacgatcaatgagctgaaggcagaagcaaaaaaggtaattcgtgataatggaaaaacatcattcattcttggcgctgactgcacacttcctacagagattccttatgacaggatccgtgcaatagcagaagcggcaagagagatataaaaggaggaaaaaagatgaaaagaacagcatcaagctttttggcggcagtaatgacagcaggcatgatcgcaggctgtgggggaaacaacgccggtacagacagtacgacggcagccgcaggcaacagcactcagtcagcagacaaggaagaaggtacggccggggataaaaccgtatatccggcaggtaccatcaccatctacggcacaggccagccccagtatcttaaggagtactatgatgcctggctggctgaccacaaagacattgctcctgatgttaagattgagatcgtgcagacagaggggcatgcacagagccgtgagaaaatcaccatgactgcactggcaggcgcagatgacgaccttcctgatgctacatacttagatccggtgaacatcatggacctttctaaggcaggaatattaaaggatgagacagagttcctgcagccctacttagataagatggtggaaggtgccgccaatgatgctgcagttaacggcaagatttacggacttccggagtcggtgcgtcccaatgtgttattctataacaaagacatttttgaaaagtacggtgtggacccggcaatgatggagacctttgacggttatgtggaggcaggccgcctgttaaaggaaaaaagcaacggtgaggtgtatttgtcctacatcagccccggcagcaggacctggaggtactggggaagaagaggtcttatgcctcaggcaaatgcaagaatctgggatgataacggcggcattgtaatcggagaagatgaagggacaaagctggctttgggaactttggacaccctctattcagaagggctcctgttaaaatctgaaatcatggagcctgcattatatgatgcaatcaacgaacagaaagtggcgaccttctacatcggtgctttctgggatgagtttatgaggaagaactgccagacgacttcaggacagtggcgggtcatgtcttcccctgtgtttgaaggcgtaggcaaggcaggtgcgcccgtatcctcctatttctgtattgtaaacaagggtgataacgtatatgccggacttttggaacagatgtggaaggattttacctttgacacccagtccagaaacacatgggtaaaatccatggaagcccagaatgctccatatgccaaccctatttcaatagaaatgcttcaggatgacttctggaaagagccttccagcttttatggcggcatgtctttccgggagatagagggcaagtgtctggaaaacggcgcaaccaacctgattgtcacacctcaggatgcagaggcagatggaattatttcagcagagctggagaattacgtggcaggcaaccagaccatggatcaggccattgccaatatggataagaacttaaaggcaaagatcggcaaggcagaaatcgttaagtagaaaggtactttatgaggggaaggacctgccttccccttgtgttttttggcaatgagccggtcgaatatgcatgcatatacatcgggcgaatgccgcatcaactaaaaaactccaaatgcgtttttcttagttgtaaaatatgaggagagatcacatgcttaagacattgaataaatataaagctccctatctgttcatactgcctttttttctgttgtttcttgtattccagctgatccccgccgtctggacctttgccatcagcttcacgaactggaagggaatcggtacgccggagttttgcgggtttggcaactataaaaagctgctgattgacaacatgttctgggatgctcttaagaatacggttgtatactggattacaggcctgatattcatactggtgctttctgtgctcattgcaagtctgttaaattcagatattttaaaaggaagggcatttttcaagacagttacattccttccgaatatctgtgcggccattgccatggggttgattttccgtatgctttttgatgagaatgtgggcctgtttaatgagcttttagtcactcttggctttcaaaaggttccctggctcaccagcactaagtattccaggattccggtgatcatgctgaatgtgtggaggaatactccctggtttaccatgattgtattttccggcctgctaaacatatccagggattattacgaagcggcgactgtagatggggccaataaatggaagcagtttttttatatcaccctgccatccctgggcaatattctgtttttctgctccattacccttaccgtggacagctggaagctttttaatgaatcctacattttgcccggaccgggcacgtccaacacatccttgttccagtacatgtatgaatctggattcaatattttcaacatgggttatgcatccgctatcggcgtgattcttattatgatactggcggtcctgtcaatgatacagatgacagtgaaaaaaagacagggagaattataggaggagagtatatgggatatacgagtaagaaaaatctggcatcctttggggttcatggagcattgataatcatttccctggtctgcattcttcctattttatggatgtgcctgatttccattaagccaacttcagaaagcatcagcgggttccagtccatttggattgctgaacctactttgagtaattttaacaagctgttttccatgatacctgtggcagccaatttctttaacagcgtatttaccactgttatggggactgtgacttccttatttttctgtgctctggcaggatttgcatttgcaaaatacaagtttccggggagaaattttctgttttattttgttattgcaaccatgctggtgcctccggaggtaggagcagttccgctgtttatcatcatgaagaaactgaatctgattaacagcctgtggtctctggtaatcccccgtatcgccacggctgtaggtattttctatatgcaccagtatatcagcgatgttcctgacgaactgatcgaggcggctaaaatagacggatgcaaggattttgaaattttccggagaattattctgccggtcattaaaccggcactggcttcctgggcttctgtaaccttgattgccagatggaatgactttttctggcctctgctgtacttgagaaaacaggcgaaatatactctgatggtaaccatttcactgcttcctgtcagcgagggcctttcaacgccctggtcggtaattctttcaggcacaacacttgtaattattccaataattgtgttatatttaatattgcagacatttcagaagtctggaatgatggcgggggctgtaaaaggctaaattaacgataagaaaaaggggaaacatgatgcagggccaatctataaaaaaccaggtgtatgagggtatcatgaaagatattctggatggcgtctaccaggcaaatgatattattaatgaaagaacgatcatagaaaaatacggggtcagcaagactcctgtgagagaagccctggtacagctgtgcagtgaagaggtgcttaataacattcctaggttcggctaccagctgactgccatacttccaagtcagattatggagattatagaatacaggaaagtgattgaactgggcgctctggagttgtgttttttccgccttaccaaagaacagattgacgaattgaagcgtcaaaatgaagaggcggtacggattaccgaaaccagggattcaaagatccactgggaagccaataatcttttccacagaaccttgtgcagctactgcggaaacagctatatacagaaatccctggcagatgccatgaatatctgtaccaggatatccaatcagtattttacaaagctatggaatgaaagcaaggtctccgacggaagcaaccacgtccatctggtagaggccattgagtccggtgatttggagcgggcaaaggcaattttgattgatgatgtggaatcgtttaagaatgagatattataagaaaagcagtataaatacaaggttacaggaaagagcgccgctgtccgtactggatatatcagtcaggacagagccgctcttttttgccgggcataagtgcaaatgggtttttccataatttttatattcatttcttctgttttatgttatactaacaaatagcaaaaagtggagggattccatgtactattttattgtaaacccgaactcacgctgcgggcggggaagaaacatttggaaaaaaatagaaagaatgttaaaagcctgccatgcggagtatcaggcctttcttacggagaagccgggagatgccagaagatttgccaaagagctgacagaaggctgcagggaatcaagtgttatcataggagtaggcggagacggaactgtaaatgaaatcctggatgggctttccttttgcggttctattactcttgggtatattcctgccggatccggtaatgatctggcaagaagcttaaagctccctaagaacccggtccgctgcttgaagaaaatactgcatccgaaatattacaaacttatggattacggagttttgtcctacggggatggagaaatatcccaccgccgttttatggtcagcgccgggatcggaatggatgcggccgtttgccacagcatcctttactctaagtcaaagggatggttccataagctttgtctcgggaagtttgcctatctcctggtgggagtcaggcagcttattctggccaagccctcaaagggatatattctcctgaacggggttcagaaggttgagttcagcaacgcttattttatatccgtccacattcacccttatgagggtggcgggtttaagtttgccccggatgcgaattttgaggacgggctgctgtctgtctgcgttatgagcaacaggaaaaaaggaaagctggttcctattcttcttcgttcacttatgggaaggaaatctttaaataggggcatcaggtattattcctgtgaggaagttatgatccatatggaccgtcccatggcagttcacgtagatggagaaagctgcttttgccaaaacgacgtgcagcttcggtgcatcagcaaaaagctgcgtatgattgtatagaaacagatattaaatagaagaaacaccctatgggtataccactatgcccaaaaagcatgggcaataaagtagaaacaccctgcgggtataccactatgcccaaaaagcgtgggcaataaagtagaaaggaagaattatgaggattggacagggatatgatgtgcataaattggcggaaggaagggatttgattctgggcggcgtgaagattccctatgaaaagggacttttgggccattctgacgcagatgtgctggtccatgcagtcatggatgcccttttaggtgcggcagctctgggagacatcggagagcatttcccggatacggatccccaatataaaggagtatccagcattgaacttttaaagcgtgtaggcgaacttttggaagagcagggatatgtgattgaaaatatcgatgccactgtcattgcacaaaagccaaagcttttgacataccggcctgagatggtaaaaaacattggcgaggccttaaagcttcctgatggaaaggtcaatgtaaaggctactacagaggaagggcttggctttaccggaaaaggagagggcataacctcccaggccatcgtcctgctgacctccatggaagattactgttatgacgacaagatcatggcagagggctgcggaggctgctgcagaggctgcgggaaataaagcggaattgatgaaacaccctgcgggtataccattacacccgatacagcggaccggactctgcccggaaagcatagcagtaaagaggaaagggagaaactatgaaaatttataatacattatccagacagaaggaagaattcgtttctttagagcccggaaaggttaagatgtatgtttgcggaccaacggtttacaatctcatacacattggaaacgcaaggcccatcatcgtatttgatacggtccggagatattttgaatataagggatatgaggtaaactttgtatcaaactttaccgatatagatgataagatcataaaaaaagccattgaagagggggtggatgctgacaccatttccaagcgttatattgcggaatgcaaaaaggatatggaaagtctgaatatcaaaccggccaccagaaatcccctggcaactgaagaaatctgcggtatgctggatatgatcgaaaaactcattgcatccggccatgcatatgaagcaaaggatggaacagtctatttccgcaccaaaacctttgaggagtatggaaagctgtctcataagaatctggaagatttacagtccggcttccgggaaattaaagtgaccggagaagacggaaaagaggatccatctgatttcgtcctttggaagcctaaaaaagaaggagagccttactgggagtctccatggtgtgaagggcgtccgggatggcatattgaatgctccgtaatgtccaagaaatatcttggggatcaaatcgatattcatgcaggcggagaagatttaatcttccccatcatgagaacgagatcgcccagagtgaggcggccaatggaaaggaatttgcgaaatactggatgcacaatggcttcctgaacattgataataaaaagatgtccaaatctttgggtaattttttcactgtacgggatatcagcgaaaagtatgatttacaggttcttcgcttctttatgctcagcgcacattacagaagccccattaatttcagcgccgatttaatggaagcatcaaagaacgggctggatagaatcctgactgctgtggataaattaaaaggactggaggcctctgcaaaaacagaaaagcttcttgaaggtgaggataaaaaggccgcacaggagctggtttccaaatatgagacagcaatggatgatgatttcaacacagcagatgctatttccgccatttttgagctggtaaaattaagcaattccaccacaaacgaagacagttccaaagaatatgtggtctacttaaagaaaaccattgaacggctgtgcgatgttcttggaattattacggaaaaaaaagaagagatcctggatgatgagatcgaagcaatgatcgcagacaggcagcaggccagaaaagacaagaactttgcccttgctgatgagatccgcggaaagcttttagaaaaggggatcgttttggaggacaccagggaaggtgtaaaatggaagagaatataacatcactgtcagggttttctgatttttttaaggatacgctgaagctgaaggaagtggatataaaatcctattctccattggcactggcttatatcggggatgcggtatatgaattgatcgtgcggacaaaggttatgaaccatggaagcacccaggtgcataatatgcataagaagagtgccaggctggtgaatgcaggagcccaggcagagatcatccgccggcttcttgaagacgaggatttaactccggaagaggtgacagcatacaagcgggggcgcaatgccaaggcggtgacgactgcaaagcatgcaaccgttgccgattacaggactgccaccggatttgaagccttgtgcggctatctgtatttaaacggcgatttagaccggctggtcaccctggtgggaaagggacttgaacgaataggagaactggaatgatagaggaatttacgatagagggaagaaatgcggttttggaagcattccgttccggaaagacgattgataagctgtacgtgcaaaagggagttcaggatggcccgatccagtccattatccgggaagcaaaaaagaaggataccatcattaatttcgtggaaagggagcgcctggaccagatgtccgaggaaggacatcatcagggggtcattgcccatgcggcagcctatgaatacgcggaagtggaagatttattaaaggcggcagaggaaaaaggggagccccccttcctcttcctgttagacgggatcgaggatccacataatctgggggcgatcatccgtacagccaatttagccggggcacatggggtcattattccaaaacgccgggcagtgggacttacggcaacggttgcaaagacctcagcaggggcgcttaattatacgccggtggccaaggtcaccaacttaacggctaccatggaagaattgaagaaaaaaggaatgtggtttgtctgtgccgatatgggcggggaaatgatgtaccgccttgatttaaaggggccaatcggccttgtaatcggcggtgagggcagcggtgtgggaaaactggtcagggaaacatgtgacatggtcgcttccatacctatgaaggggatatcgattctttgaatgcttctgtagcagcaggtgtgctggcgtatgagattgttagacaacgtttgggacaatagatgaggagagatgatgattatgaaaaagaatggtacgtttatggcggctgtttgcgccggaatactgttttctttcagcggctttgtgtcaggcagtaatattgctgcagcggacagtacagatgaaagcattgagtggaagactgtggtgaccattgaggacgatgcggttcctctttattcaaaaccggccgggagcaatgtgagaatccctcaggctccgggaacggtcacctatgggaacggctctgtgctcatcgatgcttccaatacaagccatggctatgtgatggtccagtacagcggaaattcctccaagataaaggttcaggtgataaaaggcggaggagagacgtattcctatgatttaaatgccagatcctcctatgaggtcttccctctgacggaaggaaacggaaaatacacggtccgggttctggagcaggtacaggggacccaatatgccataaaatccagcagcgatatcaatgtgacccttgcagatcagtttgatccatttctttaccctaatcagtatgtgaatttttccgcgggaagtgcggtggtgaaaatgggagaggagctggcggcttctgcaaccgatgacattggggttgtgaccaacgtttataattttgtaatcaagaatttcacttacgatacggcgctggcaagctccgttcagtccggctatctgcccaatgtggatcaggtgctggctcagaaaaaggggatctgctttgactatgcggcagttatgacagcaatgcttcgttcccaggatatccccacaaagctggtggtgggctatacgggcagcctttaccatgcgtgggtcaatgtttatattgacggccagggctgggtagacaatatcatctattttgacggatatgactggaagcttatggacccgacatttgcatcttccggaaacagtgacccggccatacagcaatatatcacaaacagctccaattataaggcaaaatatacgtactaaagaacttcatttaaaggagatacaacagatgaaaacgaaagcgaaaaagccgtattcctcaagggaactttccgctttctgccttcaaatatccattcttctccatgctgcaatccctcttgacgagggattgtctgttatggcggaggatgcggtatgggaggaagagaaaaagcttcttatacagatggcggaggaggcggagctgggcattcctttctcgaaagtgctggaaaatacaggcgtttatcctttctatgtgatccatatggcaaagctggggaggaaaccgggaccctggaccagatcatggaatccctggcaggatattatgaaaaagaacatactcttatgaagaatatcaggaatacccttacctacccggtcatcatgatctttatgcttttggtagtccttcttgttttattcaccaaggttatgcctatatttgaagatgtataccagcagctgggggcagagatgtcgccggtttctcttgctgcaacaagacttggaggtgcattctgcgcggctgccctggctctttcggtccttctggctcttacggccgcccttttgtggctccttagcagaaaagggaaaaggttcctgataacggaacggctgatccagtggctgaaaagaaggagccgtatggccctggcaatagccaaccggcgctttactgcggttctggccctgacacttcacagcgggcttgatttagaaaagggcatggaactggcaggacagctggtggagaatcgggccgtggaagaaaagatcagtggctgtggccgggagcttgaggcaggaaccgactattataccgccatgaaaaatacagggctgtttaagggcttttatgcacagatgataaaggtaggaaccagaagcggccgcctggatcaggttatggaggaaatctccagaagctatgaggaagaggcggatgctgccatggaacacatggtcagccggttcgagcccacggtggtggcagtgctggccgttgcagtggggatggtgcttttgtctgtcatgcttccacttgtcagcgttttatcggcgatcggataggaggacatctggatgaagaaatggaaaaggtctccaagggaggctcttggccagctgtttttcctggcagcctttgcaggcgtgctggttctttttgtgtcaggagtgctcactttttctaataaggccgatgctaggggagcggaaacccttcgggatgccatacgaagggcttctgtgcagtgttatgccattgagggaagatatccgcccaatgtggagtatctggaagaaaattatggaatacagattgacaggaatcggtatgatgtgttttacagcggctttgcttccaattttatgccggatattacagtcaatccccaggaaccataaccgggaggtgggcatttgaacggaaaagaaaaccagagaggccagatggcaaatactctctttaccatattgctgtttcttgtatttgtgctctgcgctttattttcggtgctcatcggaggcaaagtctatgagaatatcaatgccagggcagaggataactatcaaaaaggcgttgccttaagctacatagccaataaggtaaggcaggggatgaggccggccgggtttctctcacagagatggctggggtccctgtccttaagctggaacagaagattgaggattcggtttatgtgacccatatttattacctggatggcaggctgtgggaattgtttacagacgcagaaagcggcctgggagtgggggatggaattgaaattctggaatgcagtccggtttccatggaaatggatggcagactccttcatataataacggaaggtgagggcggaggcagcctttggctttccttaagaagcggaggggcggaagatgaatagaaaacatccttcaggcgtttttatgatggagatgattgccgttgtttttttctttatcctttgtgcgggcatctgtataaaaacatttgtaaaagcggatttcatgagccgggcggctgcggatttaaatcagggcgtgctcatcgcccaaagcgtggcagaggtctggaaaggggagggcacagagggacttgaaaagaagtttcaggctcataggcttaaggctgaccctgattcctataccatgggatttgaccgggccggcaatccctgtgaaatagaaaaagctgcctttggtgtaagcgcagaaattgccgggccggagcaggcggaagtaattgtaagcagaaatgggaaaagggtctattctcttacggtgaagagacatgaaacccaacattgacggaggtggaaccatggcaaaacaggagaacagatacaaggccaacataggcactccttcccttattctcatatttattgtcatgtgcctgataacctttgggctgctttccttaagcaccgccaaaagcgagtggaatctggcggagcgcaatgctttggctgtgacagagtattaccgggcagatggggagggggaagctttttatcagatggttttaaaacagacggcagtggtccgggaaaaaagcctggattcccaggagaggaaacggcttttggtccgggagcttggagaagcctatcatccggaggaagaaaccgtaactgtgcaaatcccaatggaacggtcccaggccctttttatagagctgctcttacagccggaggaaagggaggacatccggatatccaagtggaagataattcagacagaagattatgaaattgataattccatgcccgtgtggacaggcggagaaatgaaagatcaggagactggaaaatgaaggtaattgacttgttaagtgctgctgtggcccagaatgcatcagatatttttctggtgcctggcatgccgttttcatataaaataggaagcaggatcgtatatcagaatgaagaaaagctgtttcccgttcaaatggaacagctgatcacggaattgtatgagctggctggaaaccggacaatggaaaaggtgcgggagcatggagatgatgatttttcctttgcccttcccggtgtctccaggtttcgttccagcgtattccgtcagagaggttctcttgcggcggtgatccgggtggtaacctttgaactgcctgattacagggcgcttcatattcctgagaccgttatggaaattgccaggatgacaaaaggctttgtcctggttacagggcctgccggaagcggcaagaccaccactctggcctgtatcatcgacaaaatcaacaatacacgcaacgctcatgtgatcacccttgaagatcctcttgagtaccttcaccgccataaacagagcgtggtgacccaaagagaggttaccacggatacggacagctatgtgaccggtctacgggcggctcttcgccaggcgcctgatgtgatccttgtgggagagatgagggattatgaaaccatacggatcgccatgacggctgccgaaaccggccatctggtgatctccacccttcatacggtgggagcggccaataccattgaccgcatcatcgacaattttcctcccaatcagcagcagcagatccggatgcagctttccatggtggttcaggcagtggtttcccagcagctcattccggctttggatggcagcgtttatcctgcatttgaaatcatgtttttcaacaatgccatcaggaatatgatccgcgagtccaagactcaccagatcgattccgtgatcgccaccggccagggagaaggtatgatctccatggacgccagccttttaaatttatataaagatggaaagatcaccagggaaaacgccatcatttacagcagcaacagtgaattaatgataaaaaagatggaccgggggctgtaagcgcgcatagtttccatttcaggcagatacactatccataacaatgagaggagagtggcaggattatgagaacagataaaagaaagattgtattagtaggaacaggcatggttgggatgagctatgcctactgccttttgaaccagggagtttgtgatgaactggttctcatcgatattgacagaaaacgggcggaaggcgaggcaatggatctaaaccatgggctcgctttttctgcctctcatatgaagatctatgccggagaataccgggattgttccgatgcagacattgttgcgatctgcgcaggagttgcgcagaagcagggagagacaaggcttgacttgttaaagcgcaatgcttctgtgtttcagtccattgtgcagcctgtggcggaatccggctttaacgggattttcctggtagccaccaatccggtggatattatgacgagaatcacttattctctgtcaggctttaatcccaaacgggtgcttggaagcggcactgctctggatactgctcgcctccggtatttacttggcgaatccttgcgggtggatccgagaaatgtccatgcctatgtcatgggtgagcacggggacagtgagtttgtaccctggagccaggccatgatcgccacaaagcccattttgtccctttgtgaagaagaggaggaattggtatgcagggaagagctgaaacggatcgaagacgaagtccggggagccgcttaccggatcattgaggccaagcaggccacctattatgggattggcatggccctcaccaggatcaccagagctattcttggagatgaaaacagcgtttttacggtatcagccatgctgcggggagaatacgggcagtcggaggtttatgcaggagttccctgcatcatcaataaaaacggaatacaaagagttctttctctgtctctgacggaagaagagagaaagcagtttcacaaatcctgtgacacgcttcgggaaagttttgaaggaattttataaaaacatgtggaagagaataggaaacgggaggccggtttttcctgttctccttccctttcatggccatggatatgagtgtgattgcaggacaataattttaaatttttgttattttgtattgtttagaaaaaattttaaaaagcgttgacaaaccgattttcccatgctatgatatacgaggttcaggcgatgaaccaaaaagatgctgatgtggcacaggtggtagcgcacctcattggtagtgaggaggtcacgggtccgagtcccgtcatcagctctgaaaacaaacgggaagtcttaataaagaggcttcccgtttttgtcatatgtaaaggttaaaggagaaaatctttagccttaaggttgtgaatcaactggatatgcaagcatattcttttgatccaaaaggatacaaaaatgatgaaaaggaggcatattgatatgggaaagcataaaaagaagcacaagagtccatggtccatattctttcggccgattaaagttattcttttcgtgtttctggggatcatggttttgggctgtctggcaggcggcgtggtatttttaaaatatcagagtgagatcatggcttgtaaagagaaggcggatgccatcatggacaagaccgtcaagactgatttttcccagccaacggatacgagaatttatgattctgccggaactctgatcggaaccatcaactccggtcactatgaatacgttccgatttcagagatcagcaaaaatctgcagaatgcctacattgcccaggaggacagaaggttttataaacaccatgggatcgattacataggcttactgcgtgcaggcgtggtatacgtaaaaaataagggggcaatcacccagggtggtagtaccatcacccagcaggtcattaagaacacctatctcactcaggaacagaccttccagagaaagctgacggaatttttttccgctccccgtatggaggagaagtactcaaagtcagacatcctggaattttactgcaataccaatttctttgcaaacaggtgctacggcgtatccgaggccagccgctattattttgataaggaagcaaaagatctgactgtctgggaggcggccaccctggcgggcatcagcaataacccgtcaaggtatgatccggttgcccatccggaaacctcaaaatggaagagagatcaggtcattgacaatatggctctcaacaaatatatctccgaagaggaaagggattatgccaaggcccagcctttgacagttgctaagatttatgagccgggaacaaaggagaattacctgacaagctatgccatacactgcgccgcactggaactgatgaagaacgacggctttgtttttcagtatgtgtttaacaatcaggcctcttatgattcctataaggaagagtatcaggagctttatcaggctaaaagcgatatgatccgaaacggtgggtttgaaatacgcaccagtctggaaacatcggtccagaactctctgcaggcgatcattgatgaacggctgaagggctttaaggatctccaggagaacggtaaattcgccttacagggggcggcggtgtgcattgataaccagaccggatatgtggtagccattgtaggaggcaggggtactgatgacgagtacaaccgtggatttttaagcaaacgccagccagggtctaccataaagccgctgattgactatgctcctgcctttgaaaccggattttattatccctccaggctggtaaatgaccacttatttgacaaaggtcctaaaaacagcggaggcagctattatggcaatgtttccgtgagagaggcattgaaccgcagcttaaatacggtggcctggcaggtgctggggacatcggcgttaatacgggtatcgggtatctgggtaaaatgcattttgttggcttaagctacctggataacggaaacagcagtatgagtatcggaggttttacggaaggcgccagagtggtggatatggcaaagggatattctgttctggcaaacaaggggatgtacagcaatagaacctgtattgtcagcttacaaagccagtatgacggtgagatctacaacggaaatcaggcagatgagagaatatttacggaagataccgcttatatgatcaccgatgtgttaaaggggaccctggataagccttacggcacaggctacggcctggggcttggcattccggctgcaggaaagaccgggactaccaacagcaataaggatacctggttttgcgggtacaccaagcattacaccacagctgtctgggttggatatgacacgcctaaggcaatgccgggagtttacggaaaaacctattcaggaaggatctggcatgactttatggccgaaataaacaacgggcttcctgttctggactgggatatgcctgcaacagtttccctttggaatgtggattccagaggggaaaaaacagacgctgcaacaggaaataaggacttattttcctctgtggcagagtccgcagccagatccaatggaagtaaatggaaggaagaggaagagcgtaaaaaactggagtcccaggcgcagaaaaacttagaggcttcccagcaggcattgcaggctgtggagcaggcggctgcctccctccagtccctgatcggggaattaaccggcttaagccacagggacagctctacggaagaaaaaataagtaccgcttacggcttattagaccagctggtcaatacagaatattatgaaggattgaagagccagcttgatgcggcggtgagccacgcagagtccctgccaaagcaggaggattccggaggaaacccccaggagatcggtcctggagttacaaagcccagagagaccactgcccccgtttttccgggagattttgatcctgacggagaaaattcctccggaattggccccgccggccctgattccggaggggtggtagtaggcccggggatggaataaaagagaaaagtgtaatgggggttgctttttatgacggcagctgttatccttaattaggaaaatcattaagaaaggaagtgaaccggagtggaaggtcgaagtcagaagatggaagcagataatgatcataggcgtatggcagtgaaggcagaatcctatgctttgagtctgctctggtttcgctgccgttaaaagaggaaagtctctgcgtttatgatagccatggattacaggcaggctctgtaattatggctattttgcgttgccggaagtttggcagggcagcattaattttgcttccataatagccgcgacgaaaaaaaggttcatatggaggaagagtgaaatgcaggaaaattacaatatggaagagctgttggagctggctgacagccgtcagttccgaaagctgaaggaagtgctgaaggaatttaatgaagtggatgttgccgcttttattgaggcgctggactgggaaaaaacagtggtggtattccggatgcttccaaaggaaatggccagtgatgtgattgcatgcctggaagtggagaagcagaaacacattataaacagcataactgatcacgaactgggaacaatcgtagaagatttatttgtggatgatgtggtggacatgctggaggagctgcctgccagcgtggtaaaaagagttttgcagaatgccactcctgataccagaaagctgatcaaccagtttttgaattatccggaaaacagcgccggaagcatcatgacggctgagtatgtgggtctaaagaagaccatgaccgttgaccaggcctttgattatatcaggaagcatggagtggataaggaaaccatttacacctgttacgtgatggatgccacaagaaagctggagggggtggtcacggtcaaggacttactgatgagcccctacgaggtagccatcggcgatatcatggatacccatgtgataaaggcagtcacaacagaggaccaggaggaggtggcggacagcttccggaaatacggccttttaagtcttccggtggtggatcacgaggaccggctggtgggaatcgttaccgttgacgacgttgtggatgtcatggagcaggaggctactgaagattttgagaaaatggctgccatgatcccaagcgaaaagccctatttaaaaaccagcgtgttccagctggcgaaaaacaggatcatgtggcttctcgttctgatgatcagcagcatggtgaccggagggattctggccagatatgaggcggcctttgcggtgatccctctgcttgtgacctttattcccatgcttacggatacgggcggcaatgcgggaagccagagcagcaccatgatcatcaggggaatggccgtgggagagatcggaacaaaggatattttccgcgtggtctttaaggagctaaaggtggctatcctggtcggactgattctggggctggtgaattatgtccgcctgatcctcctttatccggggcaggaaatgctttgtctgacagtcatgctgagccttctggtcacagtgatcctggcaaagaccatcggaggagttcttccaattgcagccaaggtagttcatatggacccggcgatcatggctgctcctctcatcaccaccattgtggatgcggtcagcctgatcatatatttccagctggcatgcaggcttctggaattataattgctccggaaatttctgctaaatcattgtcttttccagttgttcgttatataatgtactatacggctttggcggcccatcacgagaaagaagatataggagtgtgttcacatgagtaaaataagaacaagatacgcaccaagccctacaggacgtatgcacgtagggaatttaagaaccgcattatatgcttacctgattgcaaaacatgaaggcggcgatttccttctgcgcatcgaagatacggatcaggaacgttttgtggaaggtgctgtcgggattatttatagaactttacaagagacaggtcttaaccatgatgaaggaccggacaaggatggcggcgtaggtccttacgtacaaagtgagcgccaggcctccggaatttatctggaatatgcaaaaaagcttgtggaaaaaggagaggcttattactgcttctgcacccaggaaagactggattccttaaaaaaaacagtggaaggccaggagatcatgacttatgacaagcactgcctccatctctccaaagaagaagtggaagccagcttaggggcaggtatgccttatgtcatccgtcagaacaatccaacagaaggaaccacagccttccatgacgaaatatatggagacatttccgtggacaactcagagcttgatgatatggttctgatcaaatccgacggattccccacttacaattttgcaaatgtggtggatgaccatcttatgggaatcactcatgtagtgagaggcaatgaatacttatcctcctctccaaaatacaaccgcctttacagcgcctttggctgggaggtccctgtatatgtccactgccccctgatcaccaacgaagagcacaagaagctgagcaaaagaagcggtcattcctcctatgaggatctgatcatgcagggctttatttctgaggctgttgtgaattatgtggctcttttaggctggtcccctgtaggcaaccaggagattttctccctggatgacctgatcagggaatttgattaccacaatatcagcaaatccccggctgttttcgacatgacaaaactgcggtggatgaacggtgaatatatgaaggccatggattttgaccgtttctatgaactggcagagccttatttgaaggcagtgatcaataaaaatctggatttaaagaagattgcagccatggtcaagaccaggatcgaggtttttccggaaattgcagatcacattgacttttttgaagctcttccggaatacgagctttccatgtacaccaataaaaaaatgaagacaggcagcgagacttccctttctgtactgcaggaagtggttcccattctggaagcccaggaggattacagcaatgatgcgctttatgagacgctttcaaagtacgtttccgaaaaggggtataaaaccggttttgtcatgtggcccatccgcactgcggtttcaggaaagcagatgactccggcaggtgctactgagatcatggaggtccttggcaaggaagaatccctggcgagaataagaaagggaatccaacttttaagcaatggggctcaataggttatattatgaaaacaaaaagatgttttcataatcggatggacggggcaaagaacgccccttttatctgaacttgcgttgcaagttcagataagctataatatagaagcagaggctcaggatcaaccgggccctgcttttcttttggtcatggtatgggctgaaacccaattgtgcttgattcattaggagggaaaattatgaaagaacaggtcatatatgagggagcgcagaaggaggcggttcttcataacaaagggcctatgatggtccttgccgggccgggatcaggaaagacatttaccatcactcaccggatatgctatttgattgaacggtacggagtggatccttccaatattcttgttatcacattcacaaaggctgcggcaagggagatgaaggagcgttttgaaagccttgtgggcggcaggccgtctgcggtcagctttggaacctttcatgccatatttttcaggatcttaaagttcgcctaccggtacgatgccagcagcatcgtgagggaggagcagaagattcagtacataaaagaagccatggacaagtgtcaggtggaggtggaggatgaggcggaatttgtgacctccatcctgtcggaaatcagctccgtaaagggagatatgatcgatttaaatcattattattctaaaaactgctctgaggagatatttaagcagctttatcttgcgtatgaagacaggcttcgcagggccaatctcattgattttgatgacatgatggtgatgtgctatgaattgttcgtccaaagaaaggacatcctggaagcatggcagaaaaagtaccaatatatcctggtggatgagtttcaggatattaaccgggtgcagtatgagatcgtccggatgcttgccgcaccggaaaataatctgtttatcgtaggggatgacgaccagtccatataccgtttccggggagcaaagccggaaatcatgctgggctttgaaaaggattatgagggagcaaaaaaggtccttttgaatatgaatttccggagcacaagagagatcgtggagacagcaggaaggctgatcgctcataatgagctgcgttttcctaaaaagatcatcacgaaaaaaggacctggaaagcctgtggtcacaagagtctggcaggatccccaggaggagaccatggaaatcgtcagggagatcatggcttatgcaaaggccgggtttgaatggcaggatattgcagttctttacagaacgaatttaggccccagactgctgatcgaaaagcttatggaatataatatcccgtttaccatgaaggattccgttcccaatctatacgaccactggatcgccaaaaacataatttcctatattcatgtggcctccggtgaattatccagggccaatgcactccagatccttaaccgccccaaccgttacatcagccgtgatgcggttgaaaccagtccggtgaactgggaatcggtgaaatctttttaccaggataagggctggatggtggagcggatcgaacagctggaatatgatttaaaaatgatcaggaacatggctcccgtggctgctgtaaactatatcaggaaggcggtgggatatgacgattatatccgggaatatgcccagtaccgaaggatgaagccggaggagcttttggaggttttagaccagcttcaggaaagtgcagccggttatcccaccacggaggaatggttctgccatatgaaggaatatggggaggagttaaaagcccaggctcagtcaggggaaggaagaaccaagggagtcgcccttatgaccatgcacagcgccaaagggctggaataccggatcgtctatattttagatgccaatgagggcgtaacgcctcatcacaaggcagttcttcctgctgatatggaggaggagaggcggatgttttacgtggcaatgacaaggccaaaggaacgtcttcacgtcaattatgtgcgggagagatacagcaaaaagcaggaggtttcccgttttgtccgggaatatttagggcgggattgacaaggaataagggaataccctgcgtgcatacctttatgtcctgaaaatatggacaatagtaaggcaaggaggagatgaaatgaagtcctgtatacacatatactgcggagatggaaagggaaagacaacggcggccataggactggctgtgcgcgcctgcggatgcgggaaaaaggtgcttattacccgattcttgaagaccgatcattccggtgaagtaaaggcattaggcgggcttgatcatattacagtcacaccctgtgaacgaagctttggctttttttcaaagatgtcccctgaacagaaaacggaagctgaaatctattattcccagctgttagagacgaccttgaataaggcggcaacagaggattttcaactgcttgttttagatgagatcatggctgtgtgcaatttcggtcttgtggaagaaaggaaggttctggagtttctttcttcgcgcccggaagggcttgaggtggtacttacagggcgggatccgtcggaaaagcttgtagaaatggcggattatgtgtcggaaatcaggaaggtaaagcatccttacgacaggggaatttcggcaaggcagggaattgaatattaaaaagaaaatcccttgatttttgccggatagtttgatagagtggaaacaggtgcagatgaatgcgccatacaactagattaagaaaaagagaggtatcgggatggcacaggatcctaatttagagcgggatgatatggaaccccaggaggaaatgacagttacactgacccttgatgacggatcagaactggagtgcgtagtacttaccattttcacagcaggagaaagagattatattgcactgcttcctatgaacggccctgaggcagaagaaggagaagtttatctgtaccgttattttgagaaagaggacggacagccgaatcttgaaaatattgaagatgatgaagaatatgagatcgttgcggatgcctttgatgaattactggacgaagcggaatacgacgagctggtaggcgaagacgaggagtaaacaaagaaaaagccggggcaggtcctttctaagggactggtcccggttttgagatttgggcgggcagtgagccgaacaaatatgcttgcatattcatttggcgtataccgcatcaacaaagaaaaacgtaatgatcaaaccttacagatcatagaatagtactgaaaatagaagcaagtacaacaagtattacaatctatcaaagttgcgttctatatactactattattgtatctatgggaagtgaggggtatctgtatggacaacgaggcggtacttaagaaaattgaggaaatcaacagaagcaaagagtggtctatgtacaggctgtcaaaagaaagcgggatcgctcagtccacattgtccagtttgtttggcaggagggccaatatcagccttccgaaacttggcaggatctgtcaggcctatggcattaaaatgtcggatttcttttctttactggaggaggaggcggaagacggagatccttgtcagaaggattatgaaatcattgagatggtccagaaagcggcaaccctgtcaaataataacaggcggcttttgcggtccatgatcattttgatggaagaactggaaagagaaaataaaagaaaaggagaacggtaaaatggaaaagattgttgacgccagaggtcttacatgtcctcagccggtgatcaaggcaaaagaggcattaaagaatatggcagaaggaactttaaaggttcttgtggacaatgaaattgcagtccagaatgtgatgaagctgggaaaatacgagggacttgctcctgtttctgaaaaaaaaggggaagaagaatttgagatcctgttccatgtggacaaaaaatcaggagatacggaagagacagcgcctgaggcagaatgcattcccgatgccaggaaaaagggccttgtggccgtgctttcatccgatcagatggggggaggcaacgaagagcttggacgacttctgatgaagggctttgtttacgctcttacccagctggacgagcttcctgagacagttttgatttacaacggcggagctaaattgtctgtggagggatcccagtcccttgaggatttaaagactctggaagcccagggagtggaggtactcacttgcgggacttgtctgaattactatggattaacggaccagctgagagttggttccgtaaccaatatgtacgaaattgtggaaaaaatggcaggtgcccgggtagtggtcaggccttaagaatctcaggtttttcatgtaagagatggtttttattgacaaaacatgggtttcgttctataattcactcagctaattttaaacatcacaggcaggcttgatttgttgtcaccgttttatttgtttgaggaggagaattatggaaaacaataaaagtgcaggaaaaagaccagtaaaagccgcagaagagaaagcagttggaaaagcaacagctaagaaagcagcggcagcagcccaggtgagtaaagtgaaggtacaggaagagaaagagagcgctgctgtcaagaaggcacctgtgaaaaaaagtgctgcgccaaggaaaacaactgcaaagaagacagagccggaagtaaccttattcattgaatattccggaaaacagattgctgcaggagaagtggtggaagcggttaaaaaggattatctgtcaaaacaggaaggtgctgcagtaaaaaccattgaagtatacgtaaaaccggaagaaaatactgcttattatgctgtgaacggggaaggctccgaccagtataagatcatgttgtagtattccgccctcgccccggtatgattttacatacggggaggtccggaaaaatggaagtgcccgtaagaagttttctttcttccgggtactttcctttttatgatcatggttttacttatctccacaggagccttggagcacagatcctttggtaaagtttttgcagcaggatggtgctggaaaggatgaagaagatttccagcacagtgctcacgatcccggtgaggaaaaagaggaaagcggacatggctgttatcatcagcaggcagtggagatagggccggtaaacctcctgattcatgcagtaaagcttccagatgatcatatagaggcagatcagaagagaaatcgatgccaaaaaggacaaaataacatggagcaccgcatgaaaaggctgggaatccggcaggtaaggggtgatgaccgccatagccaggaaaaaaaaggcaaagttgctgacagcggtttcctttttgtttctgggaagtccgcctatgatccgctttaagacataataaaaatatgttcctactatgatgccccacaggagaaacagattttttctggcggacaagcttcctaatacggaaaaattcaaagtgaaccaatcagttccccaggcaaacaaaacagtatatatgggaataataaaataagcggtaatggttattaaggacataaggcacctccgaagttcgtctctttctattttggcatttacttcggaaaataataataaacaaatgttatttttatataaaatttaaaattcagaggaaaaatgatgattcaattaccggatgaattcagggaaaaaatgaaagagcttttaggagaggggtatgattctttcatagaaagctatgacaaggaacgggttcaggggctgcgggtaaatcccttaaagatttcccgggataaatttcaaaagatatgcccttttgaattaaagaaaattccgtgggcagcagaagggtattactatcaggcggcccagcggccgggaaagcatccattccatgaggcaggcctttattatattcaggagccaagtgccatggccgttgtggaactccttgatccccagccaggagaaaagatccttgatttatgcgctgcgccgggaggaaaaaccactcatattgcagggaggcttcagggaaaaggctttcttttaagcaatgagatccatcccgccagagcgaggattctttcccagaacgtagagcgcatggggatcggaaacggggtggtgtccaatgaggattccaaaagcctgtccttgcgctttcccggtttttttgaccggattgtggtggacgcgccctgttccggcgaggggatgttccgaaaggatgaggctgccaggctggaatggaccccaggacatgtaaatgcctgcgcagtccgtcaggaagagcttctttccaatgcggcagtcatgttaaagccgggaggaaccatggtttattccacctgtaccttttcccctgaggaaaatgaacaggtcattgaaagctttcttctttcccatcccggcttttccatcaaagatatgggagagcgccccggcctttaccccggccgccggtcatggagtaaatccggtctggcggacttggaaaagacctttcgcatctggcctgataagtcagaaggagaaggccattacctggcggtattaaaaaaagacggggatgagatttctgaaaaaaagcagactgtgccggaatacaccagggacaaatccgtgttagggggattagaagagtttttaaaggatttcctggcagaccctgcccccttgcttcttagaaaagaatatattctttttggggatcagctgtatctgattcccccggaaatgatggattttaaaggcatgaaaatcatccgtccgggacttcatatggggactgtgaaaaagaaccggtttgagccgtcccatgcgttcgctcattttcttaaaaaagaagaagtaaaccgtttcattgaccttcctgctgacggagaggaaattattaaatatcttaagggagaaactcttccggaagagaccgccctttacggtgacaataaaaaaggctgggtgttagtcaatgccggaggatattccatcgggtttgccaagctggccgggggaatccttaaaaatcattatcccaaaggccttcggtggatgtaattccaaggaactgcatgtcctcaggaaggggtgcctcaaaggaaaggggctcctttttgattggatgaaggaaatccagccggaaggagtggagggcctgccgttttatgtaaccatagtcgggatgataaagaaaatctccgggaatgggatggccgatggattttaaatggacccggatctgatgtgtgcggccggtttccaggcaaagacttaccagggaatgtccggtcacagggtcataataaagccgtttataatgggtgcgcgcttcttctccatttatccggtccacacaccgttcaatggtggagccttccacacgggcgatgggagcgtcaatggtgccttccaaggggagctttccacaggcaacagccaggtagcggcggcggatctcccttttttgcaccatatctgaaaggatgcaggcgcttaaaggatttttagccagaatcaaaagtccggttgtatcccggtccagacggttgatggcccggtaaataaaagattctcctttttccttaaaataatatgccgttccgttagccagagtatggtcaaaattgccctgggacggatggatagggataccggcctccttattgacaaccaggatatgttcgtcctcgtattcaatttgaattgccatgggagtgggaacgatgttttcagagctttcatcctcacggataaagacagacaaagagtcacccggtttcaggatgcgggtggtatatacggattctcctccaaccatgattccgttttctgtgttccgaagctgccgtatcaggctctgggagtatcccaggttcaggagatactgtttcacagtcaccttttctttgatttgggttataggataagtcatagtcattttcataaacagattctaccatggagggtggcgattgacaaggagaatctatgggttataattagctggtagaaaatgaaagaggggttttaatcatgtttgatcaggatacttatgaagcattggaaatggaatttggaagaaaccgcatcacggaagatgttgaggaggttttgctggattttgcagaagccatggcagacaggggaattatggataaagaactggttttaacggaatcctatggaaagacaccggttttagtgtcagggatctgctctgaagaagagggagaagtgaacgtcctcattaagaaggtgaaggtcggtaataaggaatttgaaattaacgattattttctatagggagaaaacagggcggaagaaatggaggcagcacactcatgatgacaatcagacaggaatattcgccaaaggagatgggacttgatctcctgtgcgatctggcgggagcatttttatttaatattggaatctataattttgcggtaaacgcggagttcgcacccgtaggagtatcaggcattgcgctgattctgcgctatttgttcggccttcccatgggaattaccagcatcgtcttaaacgttcccattgtgctggtcagctaccggcttttgggccggcggtttttgctccgttccatgaagagcatggtcatctttgcccttgtgctggattacgtggtcccttatctgccggtttaccagggaaatcccctgtacgcttccgcctgtaccgggattttttccggccttggtctgactatcgtctatttaagaaactgctccacaggaggaacagactttctggtcatggccatccgaaaactgctccctcacctgaccatcggacaaatatcccttgtggtagatgccatcgtgatcattgccggaggttttgtgttccgcaacctggatgctgtcatcctgggcctgatatcttccatagtgaccaccatggtgatcgacaagatcatgtacggacttggcgccggaaagctggtctttgtggtcacctcccatgaggaagaggtggctcagagaattgaggaaaataccggccggggctgtacgtttctgcagggacagggctcctattcccgggatgaaaagaaggtggtcatgtgcgcctgcaacaacagccaggtggtgcccatccgccgtgctatccatgagattgataaggaagcattcatcattatcacagattccaacgaggtatacggagaagggtttaaggccatgggaggacagctttaggcgaaaggcgcacacttattttatgccggactttcccctgccggatgtatggtccacaatggcatccttttttaaaaagctggcccttttcacgctgtcggtgccgaatttgctgcggatatgatccacggctttttccatttctttcattttgcgggcctgttccgattcaaaaagactgagctggcaaaagccttcctctgaaatcttggtggtgcgtacgccgattaagcgtaagggggtgcggtcccatagctcctcaagcagcttgcaggcgctttcgtaaataactgtggtggagtccgtgggattgtttaaggtcacctgatgggacttggtttgaaaattccagtccttaatctccacgcagacgcagtcggacaagacatggtctgcccggaggcgggcgcccacggtttcgcttaaagataagaggacctggcgggctacttcaaggtcgtccacatcatgggaaagggtggtgctgtttccgtagcccttgtttaatggctccctctctgcaacaggggaggagtcaatgccgcaggcatagtcatggatcaaaagcgcgtattttgcccccagaaggcgctttaaatggcttacgttgcaggccgccagttctcctatggtgtgtatgccgatgccttccagctttttctgggcggaatggcccacaaaaaacagttcccggataggaagaggccacattttggaaggaatttcatgggcaaataaggtgtggcagagattgggttttttaaagtccgaggccatctttgccaaaagcttgttgggagctatgccgatgtttaccgtaaagcccagttcacgccatatcctttcccgtatctggtttgccacctctaaggggggcccgaagagatggatggtggaggtcatatcaagaaaggcttcgtcaatgctgaatttttcaatgtcaggagtgtaatcagataaaagctccataagctcaccggacttttcaaggtaaacgtcaaaccgggccggtacaacggtcagagccgggcatttgcgcagggcatggctgatgggttctccggtgatgatcccgtatgcttttgccggcgtggactttgccagaacgattccgtgccttaaggaagcgtcgccgcctactgccgatggaatggtgcgaagatcaagggcgcctgaatcctctgccagccgtctgacagattcccagcttaaaaatgctgaatttacatctatgtggaaaattaaaggttccggtgccatgtccgtccctcctttgacatcattttatcttcaaagcacttattcttttattataccgaaaatacgttcggaaagtaaagggaataattgaaaaaaatgcggaataggataaaataaattcatgggggaggctctttcatgaggcatgccataggaatactgctggcagcggtatttgtcctgattatggggacaggaactgctgcggtcaggctggcaggaaaagaggccgtcaacgagaaaacaacagtaacagaggagaaaggagaaaaaagtgcgtcggttcagacaaaggatgaattaaatctttatgcccagtcagcagttctgatggatgcctctaccggccgcatcttatatgggaagaacgaggatctggcccgtcccatggccagcaccacaaaaatcatgacctgtatacttgccctggagcacgggaatctttccgacacagtgactgccagccagaatgctgcttcccagcccaaggtccatttaggggttcataagggggagacgttcctgctgaaggatctgctttacagcctgatgctggaatcccacaatgatgccgccatgatgatcgcagagcacataggagggagccaggaaggatttgcccggctgatgaaccagaaagccagggatttaggctgtgaaaatacatattttattacacccaatggccttgatgccaaggaagaaaaggatggacaggtgaagatacattccacaacagcggcagacttagccaggatcatgaattactgcatcggccagtctccaaaaaagaaggaatttttagagatcacggcaacgaaaagctattcctttacagacctggaaagaaaacgttccttttcctgcaataaccacaatacccttctggccatgatggacggggcgtttacaggaaagaccgggtttacgggaggagccgggtattcctatgtgggggccgcccagaatgacggaagagtctacaccattgcccttttaggctgcggctggccgcctcataaggcctataaatggtcggatgcaagaaagctgttccaatatggaatggagcgctttcattacaggaacgtatataaggacattacctttcctgatattccggttaaagagggtatcccttcctccggacgcttagatgaaccggtcaccgtatcctgcggcattggagaaggggaagagaagagcttaaacctccttctggcagatgaggaagaggttacggtacagacagagcttccaaaggaattaaatgccccggtgcgcgaaggtcaggcggtgggaaccgttacttaccgcttaaacggagaggttataaaaagctatccggtgtgtctgacccagggggctgagcgcctgactacggcctggtgcttaaaaaacatagttcataaatatctgtccatgccgggggttatgggaattatcccagctttttaggataaacctgcaggaatcaggcagaaaggaatggagttctttcctttctgcctgattcctgttttttgtcatcacggggaggacggggaaaacggcagaaataaattgtataaaccattatcacgtgatatagtaaaagtgtttgtttatccaaggaaaggaaattacaaaagtatgaatatgaaaaaaattgccacagtgcttgtgggtaataccatttatgccctggccgtatccctgttcattctgccggggggactgatcacaggcgggactacggggcttgccctggttgcccatcaccagctgggcattcctgtagctgcttttgtaggggtttttaatattttaatgttcggggcgggagcctttgttttaggaaaacagtttgcattgaccactatgataagcaccttttattatcctttcatattggggatattcgaaaatcttttcggccaggcggcaatgaccggggaccggatgcttgccactgtcttttccggacttttaatcggtttgggaatcggtatggtaatacgggccggcgcttccaccggtgggatggatattcctcctttgattgttaataaaaaatggaatttatccgtgtcaatgaccatgtcagtctttgactgtctgatcctgctgtcacagatgatattttccaataaggagcagatcctttacgggatacttctggtgcttctgtattccatggttctggataaggtgcttttgatcggccgcaatcagatgcaggtaaagatcatcagtgaaaggtatgaagagatcaaccaggccatccagtcccggatggacagggggacaaccttacttgccagtgaagggggatatttaagaaaggcttcctttgccgttcttacggtaatatcagcaagacagctttccagactcaatgagcttgttatgggaattgatcccaatgcattcatgatcataaaccaggtcaatgaggtgcgggggaggggatttactctccacaaagaatataaataattggtaaaaaatgggcgagaatcttacggaaagatgactaaggtttacggtttttgaaaccctattgacttataatcctgacaggtgctatactgtggccgaactagaaaatggacgcagggaggaaccagggaaatgctgaaaaagaaaatcggtttattttgctttgccgctgttatgaccgtagtgctggcagccgggtgcggcaggaaaaatgccgcggatataggcggctcatcttcggaaacggcaaaaacagagactgcggccgtaaggatggagaaatccggaacagaagaaaaggctgatgaagaggctgtaacggaagatgatatggaccagtcagggccgggaacagaggccacagaggaagaggaaagctccggaccgggaaaaaaggtggaggcttttgccgaaaaaatccaggaggcggtagcggaccgggatttacaggccttgggggatctgctgttttatccctgtgttttcataacaggtgatgaggaaaccatcactcttaacagcctggaggatttgcttaaacagaatccggatatggtgtttggagacgatcttatggtagcggtggccaatgtggataccgtttctctgaaaatgacggataaaggtgtggtcatgggagaagagacatcaaaagtcacttttcaggaaagatcagacggaagcctggggattacggagatcagggaataggcgtttacagtgcctattgataaaaaaaaccaaggcaaagtgctccgaaatatgggattgtgataaaatactaacatgaaaaatggacggaaaattatggattgtaagaaattcatagttttctgtctttttttatgccaaaagtacttgaaatttgcctaaattagttatacaattataattggcataaattggtgttattctatggctttttgttaataacttaacagagagctataaaaatattacaaaatggaggactgcaaaatgagtaattcaacgaaaaactcagcaagcgaccgaattcgagctttgcttgatgagaacagttttgttgaagttggcggctatgttaccgcaaggagcacagacttcaacatgacggcaaaggaaactcctgctgacggtgttgtcactggctatggtaccattgaaggaagccttgtttatgtgtatagccaggacgcattggttctgggcggctccgtaggagagatgcacgcaaggaagatcacaaagctctatgctatggcgatgaagaccggcgcaccggtcatcggcctggttgattgtgctggcttaagacttcaggaagcaacagactccttaaacggatttggcgagatttatatgagtcagaccctggcatccggagtgattcctcagataacggcaatatttggaacttgcggcggaggtatggctgtttccgcagcaatggcagactttacctttatggaaaccaggggaggaaaactttttgtcaattcccccaatgccattgaaggaaattatacagaaaaatgcaatacagcttccgcggactatcagagcagggaaaccggcctggtggattttatgggagaagaggacgatattttaaataaaatcaggactctcatttccattcttcctgccaacagtgaggatgacatgtcttatgatgagtgcagtgacgatttaaaccgtgtatgctcggatctggagaattatgtgggcgatacggcgatcgcgcttgctcagatttccgataatcagttctttatggagaccaggaaggaatatgcttcttccatggtcacaggttttatccgtttaaatggcatgacagttggctgtgttgcaaacagaacggagtcttataatgaaagcggtcttaagacagcggaatacgatgcccttttaagcgggcagggctgtgaaaaagctgcaaggttcattaatttctgtgatgcattcagcattcctgtgcttaccttcgtaaatgtaaaaggatatgaggcgtctgcatattccgagaaaaccattgccagggcagcagcagggcttacctatgcctttgccaatgcaacggttcccaaggtcacggtcattcttgggcaggcccttggaactgcatatctgaccatgaacagcaagtccattggagcagatgtggtttatgcgtggccgtcggccagtgtcggcatgatggaaccgaatgaagcggtaaagatcatgtattccgatgagatcgcaaaggctgaggatggaaaaaaccttataaatgataaggcggaaagttataagcttctccaatccagcgccctttccgcagctaagagaggatatgtggatgatatcattgctgccggtgagaccagagcccgcgtcattgcagcatttgagatgctgttcacaaagagagaggatcgtccggcaaaaaaacatggcacgatttagaatgaggtgacaggtatatgaaactgaatataaaaccagcagtattgggacttgttatggcagcctgcctcttttcattatctgcatgcagcaaagccgataccgtatcagaagaaatcgatgctggtgtcctaacgcagatggaacagcttccaggctccttcctggaactgtatgccggccttgaagacagccaggtagctgagtttaagaagaacatgcttgcccaggatcaatatgccgccttggcagagggtgtggattcctgggtgaatataaaaggtgagcttggggccttggtatccatcagcgatgatgtgaaggtggaggccattgaccatgggtatagtgccacggttgatgcggcatttgaaaagaggaatatggaattttccattacaacagattcaaagctcactaagattaccggcgtggcatttgttccggaatataccttaggcgaacggatggaaaaggccgtgttcaacaccctgatgggcatggggactgtgttccttgtactgatatttatcagcgtgctgatcggaggtttccggtatatcggtaaatttgaagaaaagatgaaaggcaaggcacaggagactgcttccaaaccaattccggaggctcctgcccctgttgcagcacaagatgcacaagaggaagaggaacttgtagatgacttagagctggtagcggtaatcaccgcagccattgcagcatccactggaagttcgccccagggcctggtggtccgttcgatcaaacgtgcaccggccggtaaatggaaaaaagcttaatcaaacaggaggaataacatcatgaagaattatacaattacagtaaacggaaatgtttatgaagtaaccgtggaagaaggcacatctgcaggcgcaccggcagcggctaaaagaccggcggcaccggctccttctgcacctagtccagctcctgtccccgcggcagcaccggctcctgcagcagcggctccggtaaaggcgaccagcgcaggtacagaaggcgctgtaaaggtagcggctcccatgcctggaaagatccttggagtcaagaccagtgcaggccaggctgttaagcggggggatgtgctgattgtgctggaggccatgaaaatggagaacgaaatcgtggcaccctccgatggaacagttgccagcgttaatgtagcggtcggcgattccgtagaagcaggagcgaccttggcaactttggcatgattttctcaataaacgtgaataaaacacagcttgagtttagaaaatcagccgttcgatgagctgccaggcgaatcgaacttccttaaatgagaacaatgggatccgcttaaaagataaacaggcgggtttcatatggagggattaacatggattatattagtaatacatttaccaatcttcttcagcagaccgcattttttaacctgaccgcaggaaatatgatcatgatccttgtagcctttatatttttatacctggctataaggaaaggctttgagcccctgcttctggtaccgatttcctttggtatgctgttggtcaatatctatccggatattatgaaggaggccggaccagatggttcaggaggcggactgctgctgtacttctttaaactggatgaatggggcatcctgcctcccctgattttcatgggcgtgggagccatgacggattttggccctttgatcgccaatccaaaaagcttccttttgggagctgcagcccagttcggaatatactccgcttattttcttgcgatttttatgggctttagtgataaggcggctgcggccatctccatcatcggcggggctgatgggccgacttccatattccttgctggaaagctgggaatgactgccctgatggggccaattgcggttgctgcttattcctatatggcgctggtgcctattatccagccgccgatcatgaaacttctgacaacagaaaaagaaagaaagatcaagatggagcagctccgtcccgtatcacggcttgaaaggatcttatttcccattatcgtaacaacggtggtgtgtctgattcttcctacaacagctcctctggtgggcatgctgatgttaggaaacttattcagggaatccggcgtagtgaagcagctgacagagacggccggaaatgccttgatgtatatcgtggtaattctgctgggaacttcagtaggtgcaacaacaagcgcagaagcatttctgaatttgaacaccataaaaatcgtggttctgggcttggtagccttttcaataggaacagcagcaggcgtgctgtttggcaagctgatgtgtaaggttaccggaggcaaggtgaatcctctcatcggctccgcaggcgtatcagctgttcccatgtccgcccgtgtatcccagaaggtgggctctgaggcggatccgactaatttcctgctgatgcatgccatgggacctaatgtggcaggcgttatcggcaccgcggttgcggccggtacgtttatggcaatattcggagtaagataatttggaaaggcattaagcctttccttcaatcagatgaatgaataataaccaggaggtaagacaatggcagaaatagtaaaaaagccggttaagattgtagagacagttctccgtgatgctcatcagtctttgcttgctacaagaatgactactgaacagatgcttcccattgtggaaaagatggatcaggttggttatcatgcggtggaatgctggggcggcgcaacctttgactcatgccttcgctttctgaaggaagatccctggataaggcttagaaagctgagagatggctttaagaatacaaagctgcagatgctgttccgggggcagaatattctgggttataaccattatgcagatgatgtagtagagtactttgtccagaaatctctggcaaacggcattgatatcatccgtatctttgactgttttaacgatctccgcaacttacagaccgcagtgactgcctgtaacagggaaaagggccatgcacaggtggctttgtgctacactctgggagaggcctataccctggattactggaaggacattgcaaaaaggatcgaggatatgggagcggattccatcggcatcaaggatatggcagggcttttgacgccttataaggctgacgaactggtccgtgccttaaaagaatctacaaagcttcccattgacatgcacacacattatacttccggtgttgcgtccatgacctatttaaagggagtggaagcgggctgtgatatcattgacacagcaatgtcaccccttgcactgggtaccagccagcctgcaacagaggttatggtggagaccttccggggaacgccttatgacacgggctttgaccagaaccttctggcagagatctgcgcatacttccagcctgtcagggaagaggctttaaagagcggacgcttaaatcccaaggtattgggcgtggatatcaaaacccttcagtaccaggtgcccggcggcatgctttccaatctggtcagccagctaaaggaagcgggccaggaagacaggtatatggatgttcttcaggagatacccagagtgagaaaagagttcggagaaccgcctcttgttactccgtcttcccagattgtagggactcaggcagtgctgaatgtcataagcggggaacgctataagatcgtaacaaaagaaactaagaagatattcttaggcgaattcggacagacggttaagccttttgatgcagaggtgcagaaaaagatcatcggcgatgagacgccgatcacctgccgtccggcggatttaattgctccccagctggagcggtttgaaaaggaatgtgcccagtggaagcagcaggatgaggatgtattatcctatgccctgttcccgggtgtagcaaaagagttctttgagtaccgggccgctcagcagaccggcgtagattcttccttggcagataaggaaagcaaggtttatccggtatagttttgtaaataaggtctctcacttttgagaggccccagattgtcaggaaaccccatttcaaacggaaaaatggggtttcttttagttatggggcatagatgaaatttcatgctttctttttcatgaatgaaccattatactgtaattaaactcaatgccatggagaagagaatgaaaagcataagaaaaatcagaaaagaaaaaaagctcactttagaagacttaagtcaaaagaccggctataccatagggtatttatcccagctggaacgtcagctgagaactcccaccctgaatacccttcgaaagattgcctttgcctttgaccttgatgttacggatcttttatccgatgacaatcctggctctgatcctgtttctgatgtaagcgggaatgaatatattttagtaaaaaagggagaacgaaatcctctttatattgacgaattggatctgacttatgaaatcatcatgcagaatcatacaaataccagcaaaataaaggcaatggtctgtgtgttaaaacccggagacctgggtacaggcagcagggtggagcataccaccgatgagttcatcctggttttaaaaggggatatgtactgtgaattaggcgatgcctccattaaaatgacagaaggtgacagcttactgatacctgcaaaatgtcctcatacctttaaaaaccaatttgataagcctgcggagatactcatggtattaagctgactgcgattatgaaaagatatggagattaacaatggaattttcaaaaaattttactctcagctaaaaaaatgttgacaaatagaaaaggttgttatagtattaccataataacacggcaaaggtgcttaaaacacctctgccgtgtttttgcgtgtaaacatcgtccagggttcttaaacaaacaggaggagttagtatgaagagaaacaaattgaaaaaactatttgctttggttacctgcgtttcgttattggccggcttaaccggctgcgggagcaatacaaaatccacaggtgcacagacaacaggagaaccggctgcaaaagcggatacctccccaaactcctctccctcaggagatgacaataccttaaaagtgggaattttacttgatactttgggaaatatggatgtcatgcttacttcccagaataccgtattccagatttctgataccattaccgatacgcttatgggaaaggatgacgaaacattggaattatatcccctgttgctggaaaaagctcctgaaatatctgaggatggtttgatttatacctgcacactgaaaaaaggagttaaattccatgacgggacagaattaaaagccgatgatgtgatctttacttttaaccgtttctttgatccgtcaacgggaagcaatatgacgtggctttgtgatgatgtgattaagggcgcttatgagatggaagacggaaccgcaacagaagtttccggaattcaaaaagtagatgactatacctttaccattgaattaaattactcattttcagcctttacatcgattcttgccgcttctcctcttgcaatcataccaaaggaggcatgcctggccgccggagataagtggggtctggaaacatacataggaaccggctcctacaaagtagaaagctttactcccaaggaagaaatcgttttaacaaaatttgatgactatttcggcggtgccaaggccacagataagattgttattaccaacatggatgaaaatacaggacttatggagtttgaagccggcaatattgacgtttgtaccttaccgacttctcttgcacaggattatctggcagatccccagttatctgacaatgtaaaataccaggaatttatgggaatctgggcgttgcattttaacatggcagttgaaccctttgataacaaactggtcagagaggcagttgcttatgccgtagacttgaatgctttgtgcaacgactattacgaaggagcccatacccctggaaacagcctgataccaaaaggaattccaggttatgatgaaaacaatcctgttcatgaatacaatccggaaaaggcaaaagagctgttggcagaagccggatatcctgacggcctgacttttaaggcagctgtcaaaaacacggaaacgatcgtggagtgtttccaggtattacaggcccagttaaaagcgtccaatatcaacatggaattagaactgtgtgatccgggaagctgggcggagaagagaaaacaggatggcggaacacagatgtatatgatcacctggtatgcggactatgtggatcctgatatgttcttatatctgctgtaccacagttccgtatccgacaattttgcaaatggatttagctcccaatataatgcagaggattctgcctggtatgatgctcaggttgaagcaggaagaaaaataacagatccggatgaaaagatcaaattttattctgacatagaaagatggctgacaaccgaatattatgctgaagtgcctctgttctgcgcttctgaatattatatggtttctgacagagtcacaggtgttgtctataagagtgatttcttgtacagctatgaaaacgcagtagtcaataaacggtaaataccaggatcaggcataggatttctgtcagccggccggtacttagggacagatcgcagacatctgtccctatatgaaaagaaaggataggaaggatgtcttatggcaaaatattttgtgaaacgattgggtcaggcattcattgttttaatcggtgttaccctggttacttttctgttattaaatgtaattcccggtgacccggttgccgttatgcttgataaaagcgcttccccccagacggtggaaaatctgaggcgtgaatggggactggaccggccgcttcctgtacaatatttaagctttgtactgaatgccttcagcggtaatctggggaacagctattttgaaaaaacttccgtaataaatatgctggcatcaggcctgtccgcaaccttaaaagtaggaccatctcttttttattttccggttttatagggatcatctgcgggaccctggcagccgttttccgcggaaagccggcggacaaggtattcatgattgttgcaatgcttggcatctctctgccggtgttctggattgcaattgtatttcagatcatctttggattaaaactgcactggctgcctatatccggactcaagtctctctccggttatattcttcccatgattgctcttggttcaacctatgccggttccatggccagactggtccgtaccagtgtgctggatgccatttctcaggattatgtaaaaactgcaagggcaaagggcgttcatgaagtcatgatcattataaggcacgtcatgaggaatgcagccatccccattgttaccttatccggcacacagatgaaatccattttaactggttccatgatcatagaaaccattttttccatatcaggtatcggaaaaatagcgatcaatgcgattatggtccgtgatattccggtgatacaaggcactgttttgtatactgccgcactatttgttctgatcaatttgattattgatttactctacggggtaattgatccccgtatcagagtttcgtaaggggaatcagttatgaaaatattacaatcattgtttaacagaaatgctttatacgaagaaatcggaatgagtgatctggaatccaccagcctgtataaggatgcatggaaacggtttaaaaaaaataaatttgccatggtttgtctggtccttattattttgctggctgtcattgctgtttttgcaccgttcatcgctcctcatgatccttatgagcaggatgtgctgaacaagtttgcagacatttcggccgcgcacccgctggggacggataattatggaagagatattctttcccgtattatttacggtacaaggatctctctggccgtcggtattgtggctgaagccattgccgttaccatagggtgatcgtgggcactgcggccggttactatgggggaaagattgatacggtattatccagaattattgagattttcgcctcttttccctttatcttatttgcgattgcggtcatgtttattctgggacagggaattatgaatgtattcattgcaatcggtgtgatcggctggacaggacatgccagattgatcagaagtcaggttttgcagctgcgtacaaaagaatatgcagaggcagccagggcagcaggtgcatctgatttcaggatcatggtaaagcatatgattcccaactgtttatccaccatcattgtcatcaccacactggatatcccaagcgatattatgctggaggccacattaagctttctgggccttggtgtggcgccgcccactgcaagctgggggagatgatcagtacggcacggacctttttaagacagcagcctatgttcagcatttatccgggcattgccattatgatcaccgttctggcctttaataccttaggggatgcccttagagatgccctggatccgaaactgaaaaatatgtaggaggaatgtacgatggaaaaagatattttattggaagtaaaagatttacagactcactttttcctggaagaaggaaacgtaaaagcattagacggcatatccttttgcatcagacagggagaaacccttggcgtggtaggggaatccggctgcggaaagagcttgacggcgctctctgttatgcgccaggtgccggatcccccgggagaattgcaggcggtgaggtcctttttgaaggtgaggatttattaaagaaaagcaacgctgaaatgcggaaaatacggggcggaaaaattgcgatgattttccaggaacccatgacctccttaaaccctgttatgaccgttggaatacagattgcagaaaccttgcggattcatcagaaaatatcccgcagggaggctaagcaaaaagcaattgaaatgcttcgtctggttaagattccccttccggagcaaagatatggggaatatcctcatcaattatccggaggaatgcgccaaagagttatgattggcatggcactggcctgcagccccgatttactgatctgtgatgaacctaccacagccttagacgttaccgtacaggcgcagattttgcagctgattgaggaattaaagaagtccttacatatggctgttatgctcattacccatgatcttggtgttatctcttctgtcgcagataaggttattatcatgtatgcgggaaaaatcgtggaatacggcgccggtgagaatatctttctaagtcccctgcatccatatacgaaagcgctcttgtcctctgtacccaaaatcacggaagatacagagaaagacttgtatatgataaaaggcatggttccgaatcttctggaaaaacatgagggctgtttgtttgctcccagatgtgactatgcctgtgataaatgctttcgtgaaaagcccgaatttattggccggccgtccggaacggtacgctgctttcggtatgcatctgactgggagggaaaataaatgagtgaatacatcatggaagtgaaaaatctttcaaaatggttttccttaaagaagaaagggaaaaatggccaaaagctctatgtaaaggcggtaaaccaggtgagcttcggtataaaagaaggggagaccctgggcattgtaggagaatcgggctgcggtaaaaccacgctggggcgtacgcttgtaaagcttatacagccttccggcggaaccattttatatgatcaggaggatgtgaccggttttaatgataaaagattccgcccttacagaaaaaatattcagattatgtttcaggatccctacgcttccttggatccccggatgactgtcggtgatattattggggaaccaatggacgttcaaaagctctattccaataaaaaggaacgcctccagcgaattgtggagctaatggagctgtgcgggttaaacaaatactatattaccagatatcctcatgaattttccggaggacaaagacaaagaatcggaattgccagggcattatctgtaaatcccaggctgattctatgtgatgagccggtttccgcacttgatgtgtccatacagtcccagattattaaccttttaatggaactgcaaaaacggctgcatttatctctggtatttatctctcatgatttaagtgtggtacaccatatagcagacagaatcgccgtcatgtatttaggacagatcgtggaactggcggacaagaaggaattgtacaaaaatcccctgcatccttatacacaggccttattaagtgccattcccattgttggagaaaagtcttttgaaaaaatgcagcttttggagggagatctgccaagtcctgtgaatctgccatcaggctgtccttttcatacacggtgcaggtatgcagcccctgaatgcctgcaaaaaactcctgaactcatggaggccgcgcccgatcacatggtttcctgcttaaaggtatttaaaaattgattcttactaaaaaacgtaaatatggagaaaaaaatggcccgaataaatgatgattattggaatgctgcaatgcagatacataaaaagcatcccgtggtcgatgctcatttggatttggcagcggaaatccatctaagataccagtccggagaaaaggaagtaatcaggaaccactatctggataatttaaaaaaaggcggtgtgaatctggttgtatcttctgtgtttgttgtcagccaggatctgcctgagagaggactgaaacaggctttaaatcagatcagcgccttattgatggacttaaaatctgtgtctgatgaggtattgttagtaaaaacaaaacatgatctggaaactgtactggcatcagataaaataggaatcatcctttatatggaaggacttgatcccattggcgctgaaaaggatcttttatgggctttttatgaaatgggggtgagaggagctagccttacctggagcagaaggaattattttgcagagggctgctgtaatgcctcggatttaaaagatataaaaggcggattatcgctgctggggcgggaaaccgtagctcttatggaagaaatacctatgtttctggatatcagccatttaaatgatgagggctttaaagaattagcctccctgacatcaaagccctttattgcaactcattccaatgcccgaagcattcatatgaattaccggaatttaacagatgagcagatccttgtgctggcaaagcaaaacggaatcatggggctgaatgcttataaagatattgtcggagcagatccctctctggattcagttcccaaaatgtgtgatcatttagagcatgtcattcgtcttgccggtgattctcatgttggttttggttttgatttgtgcgactcctattttatggcagtatctggacataatatagaaaaaccaaaggaagactgtattactagccatgcccagattccagaaattacggcggaattgctgaggcggggtcattcagaggaaaccatagccaaaataatcggcggaaattttttgacttatttttatgaatttctgccatgagaacagttgctcatcttcggagcagtcattccttccgcttgatttattcttttgcaactcccataaaaatgctccttttcaatgagaattatcgtatcttaattctcactgaaaggagcatttgatttagagttaaagttgtttgcataagtaaggatcagtttacactctgagagtaattcatgctattgaagatcctggatccgtctttttttcagatacagcacgcagccggacaggagcatgacaacaatcagtacaagagtggactttgcgttgttttcttctttggaaaaatccagagttatttcctgcagggaggtaccgggcgaaaactctgcgtgtatttcaagatttcgatattggggttcctgtttaaaaggttgaaagcttaaaattccgtccattcggtaaaggtaactgccgccgtttccagatatgggctgccagtcgctgacgttattgggatcatcgtcctggacccgcaggaaaatcttgagatttcctttaccggtccattttactgtaatccggtcaaaagaagggacggtcatgattccgtagtaattgccgccttccttagaatctgctttcagttcatcgtttgacagcataagtccatttgtttcattgcctttttcttcccatagcctggaaactgataaggtttcctcgctttttccgctggcagggaaggaagagagacaaataaaacaagcagctagacagaggagggcagaaacgggactggcttttgggagatcaatagccataagccaaagctccgccgtctaaggcataatcctgaccggtgatatagctgccattgggtccgatcagcaatctggccagtgctccgagatcttctgcatgacccagcttatgcattggcatacgtccgaggattttagcaccgcgttcctcatccatgatgtcgtctaacattttgctgtggaaccaccctggagcaatgctgttgacgcagatgccatcttccgcccattccacggcaagaccgcgggtcattccacatacggcagccttgctggtgcagtagggaacgacctgggaaaagcccagatgagcgctcatgctggagatgtttacaattctgcctttatatgggctgttctttagaaacggatagcagatctggctcatgcggaatacgcaggccacattgacgtttatgatccggttaaattcctcttctggaaaatcctgtgccagacatttaaacgttgcgccggcattgtttatgagaaaatccagatggccgccgtgacgggcggcaagctcttggcagatcttttccatagcatggaaatcactgatatcacctttgatatgttcggttccctttatgctttcctcatatccttcttttgtctttccggaacggctgataatgtatactgcagcgccggcctcggccagtgcgtttgccatggccagtccgattccgctgcttccgccggtaatgattccggcacgtccttctaactctttcatgatattctcctcattaaagttctagtttacggtgactgcggcaggacttttcgatcagttcccagtcaagctcggcgccgatgcctggtttatccggtaccgtaatgattccgtttttaattggcagctttcccttcatgggcagctgatagttttcttcggggacgaaatattcgaaatattcgcagttacgaattgcacagctgacatggaggttgaccaaatccatatagttcatggtagttgtatgaatttcgcagttcaaaccgaagccttctgccatgtgtgcgatctttaaggtccctgtaatgccgtctttccagcttacatctgcccggacaatatccgcagaccgctgggcaatggcctgagctacgccccagtgtgcacctctggttgtttccgttgcggcaatggggatatccagggtccggcaaagctcggtgtacttataaagttcaaaatcccggaatggttcctccagccatttgtagcccaacccttccagctggcggcctatggctaccgcatctcccatggtgtattcagcaacaggatcgctcatcagaatgtagtcagagccaacggcatcccgaagggccttatgtacctccatatcaaaggccgcaggtccggctggatgggccttataaccgggaactcccaatgctttgtaatgaagagcctcgtcaacgtattccttaactgtggaatgaaaatttccgctggcataaaccggaagactgcttcggtatgctccaatgtatttatatagcgggatccctgcttccctggcgcagatatcccataaagcaacgtcaatggggccaggcagatacaccgggaaaaatgtcaggtgacggtcaatgttccaaagctcgtgccagatcgcttcccggtcatgagggtcccgtccaaggataaccggcgcaatgttatcataaagataagcttcgctgactgcgccgcttctggccgccaggcaggtggcggttccatagacccctgtgtctgtgccgattcggattgcaatgacatcccagtccatagctgcgtttccctggcgttttttgtcaaatagacaatgttctctgctgacccaccaggtttcaaaggttacgattttcataattgtcttctccatttctttacggaatgttttggcatattgctgcaaagaagctgccatagctcttcttttgtgccttttgtgatgcagttgtcgggaagaataaatgcccgtttttgtgtgtaatacaaaaatgtacagtctccgactttatgagcggcagaaagatctttccagtcataggaactgtgctcctttttggtgtctgcagaaatgccgctgtggttaaggtgaatggtgtatgcctcatatgggttatcttccagatgaagtttttgtatctgtgcttttacgctgtttttgtattgatacagataaactgcaggaaacaggaatcctatccctgcaaagacagcacacagaacctggcttccggttataagctggaaccatccaaacagaaagagcagggctgcaaatgcaatcaggcttaaaaaacggtgatgcaaacgaaatgcctggaaattggaaaaactgcaaaactgctctttgcttatagcaacatgcataataatttttggatcaaaagactgttccatattatttactcccttctgaaatcggacatttgcagaaatatagtatcatatgcggttttaaaagtaaatactaaaacgttttttatgtaaaaatgaacaaaataccataatgttgtcgttttataagaaaatattttattattagaagtgataaaatgaggtgaagtaaaataatgcacaaaatattaagaattataaaaatattattgacaaaaaggtgaatatattataatctttttgcataaggcttttgaaacgttttagtaactgaaaaggtcttgcaaaaactatattctaattttattcaggaggaaagatcatgaaaaaattactggctatgacgcttgtaactgctatggcagccagcctggcaggctgtggatccggatccggttctaccgatgcagccacaactgcagcaccgtcaaaagagacaaaggcagcagaaaccacagcagcaaaaaccggttccgctgcgccggagcttgtttttaagtacgcagaattaaacagcgatgacaacatcaataccaaggtggggtacaagtttgccgcttacgttgacgatatgtccaatggccgcattaagatcgaggtatattccgcatcaaccctgggggatgaaaaaacctgtctgaatgctttgcaaatgggcgggggaactgttgacatgtatcgcggaaacaccaactccttatccgattatggttttaagaaattaaacatattcggactgccgtttatcttttccagccgtgaaggaatgtggaaggttctggaagaaaaggaattgggtcaggcattcttaacagaaggaagtgaagtgggtgccggaatggtagggttattttataccgatgaaggggctcgtaatatgttcacctccaaggagattaagggattggatgatattaagaacaaaaagatccgcgtgccggaaacagctcttatgatggataccatgtcagcgctgggtgcacagcctacaccgatttcttacagcgagttatacagttccctgcagacaggcgtcgtagatggagctgaaaatggtctgccgggatatgcctccaataaattctatgaagtcgctccttattatttaatgagcggacatactttcagccctggaatcgttatgatggcggaagcaaagtggaatgccttaagtgaagaggacaaggagatcttactggcagccggacagaaggcatcagactggaacaaaggtgaaatcgaggcagaagagactgctctccggaaagaactggaagataaaggcgttaccattattgaaatgaccgatgaagacaaggcgaaagcccaggctgcctgtgagagtgtatgggcaagctataccgccggaatggaagatctgttacagaaaatgcttgaggttcagaagtaaatatccatggtttaaaagggcagagatgttctgcccttctgttatctgagtgattcctataatacttgttaggaggagacataagtgaagaaattctatgatgctgtgtactggctgtttatgtcattttgcaagattgttttcattgcctctatctgcattacaacatttgtggtgttttgccgatacatactgcacatcactcccaggtggggagaacaggccattctgctttgtatggtatatatggcactgatcagtgcttcccttgccgtccgcacagatactcatatccgcgttatgctgattgattatctgctgccaacaaaggccattgattttttaaaggccatgagtcatttctgtatttttgcattcagcgtgttcatgatcgtgtacggaatccaatttacaaagctgatgcaggccagtatcatgtcaggccttggctgcaagcaaagcgttttgtatgcttcagtgcccattgccggtatctgcatgcttttgatgcagagtgaacgttttcttctgttccttttgcaattgctgggcaagaccccggcgggttatgaaaagaaaggaggaaaataaaatggtgaatgaatccgttgcaatcattttattgcttactacgttttttggctttattgccttccgcatgccggtggcatatgccatcggtgtatccagcgtcattaccatggcctatttaaagcttccgctgatgcaggtggtccagctgatggtaaaaggtgtgttttctttttccctgatggcagttccgttttttattattgcaggtgagatcatgggaaagggcgggatttcagaccgtctgattgatttgtccgatgcattggtaggttggatccagggcggtcttgccatggtaaatattgtggcttccatgtttttcggcggcatttccggttcctccgcagcagatacggcatctcttggcacgatcctgataccgatgatggtagatcagggatatgatgatgattttgccacaaatgttaccatggcaagctctgtacaggggattctcatacctcccagccacaatatggttatttttgctacggttgccggcagtgtgtccatagggcgccttttccttgccggctttgttccgggcgttgttttaggcgtcgccctgatgatctatagttatattatttccataaagaaaaattatcccaagggcggggccttcagccttaagagactgatcagggtttccggagaggccgtatggggaatgtttacggtgatgattgttgtggtgggagtagttgccggtgtttttactgccacagaatccgctgccattgcagttgtatgggcatttttcgtatccatatttatataccggaaaatgaaaataaaagacgtctggtatgtcattgagaacgctttgaatacgctggcaattgtcctgatcctgatcgcaacctcatctgcttttggatggctgctgacctatttaaaagtaccggtccttatttccaatgcaattcttggtataacgaccaacaaatatttaattctggtcatgatgaacgttctgatgctgatttttggaaccatgatggatatgagctgtatcattttggtcctgactccgattctccttcctatcgccaccagtgttggggtggacccggttcactttggtgttatcatgatcgttaatctgggaatcggcctgattaccccgccggttgggtccaccctgtttatcggagctgccatatccaaaattcccattgaacgtctttcgaagactctggtgccgttctatctggttatgctgctcgttttactgattgttacctatattcctgcatttgtcatgttcctgccgaatatgatcatgccggtataaggaaaacagaatcggctgctgcgttccgtccaggtgctgcagcagcattttttacctcattaggcagggaagcggattgcgaatatccgatttactaggattataataaggagagtttatcattatggctgtatggaaaaacgatgaagaaatgtttgagctgatgaagagcagattatatactccggtggtgggagatatcctggatcagatggggtatactcatcagtttcttcctgcggagatccgtcctctggctgcactggcgccggtccggattttcggaaattcagaagagccggataaccggattaagctggcaggttatgcctgtacggtactggaaaacgatgtatacggtatgccggaaaaacccttcggatatctgacagaggctctggaccagttaaggcccaatgaagtctacattgcaaccggtgctcataacagtgccctgtggggagaactgctgacaaccaccgcaaaggtccgggggcagcaggtgccgtagtggatggctatacccgtgatactcctcaggtgctggatataaactggccggtttttgccagggcatgctgggcccaggattccagcgtacgcacgtatgtttatgactaccgctgtaccattgagatcggccaggtgacgatacatgacggggatctggttttcggtgatattgacggtgtattgatcattccgaaggaagtggcagaggaagttctggaaaaggcgcttttaaaagctgcgggagagaaaaaggtacgtaaggcaattgaaagcggaatgagtgccacagaggcatttgctacttttggaattctgtaatcagccttggggaagagctttatgcgctcccaaaagaggcagaaaaggagaaaggagaaaaggcgtgattgcatttcagatacatttttcggacaatgtggcaaccgctctgggacctttgcatcccggaaatgtattgctgcggggagacacttcttttccgtcggtggaagcagttgggaaggttccggccggacataagattgccctgagaatgattgaggcaggagcggatatcataaaatacggggtggtaatcgggcgcgcaacagaaaacatctccccaggaagctgggttcatcttcataatatctgcagtttatatgatgagcgttccggccatctggacgaggtgacaggtgctcccaaggataccagatatgaatagaggagggacagatgtggatttgcaggatgtgcgctggcttggatatgggcgaaagaacggcataaaggggatcagaaaccgggtgctggttatttatacggtaaaatgcagcgaatttgtagccagacagatcgtggaaaaggcaggcagccctgatgtggagctggttggatttgacggttgtacagacaatcaatatgcggtgaatctgttgatcagcctcatccgccatccgaatataggcggtgtgcttgcagtcggattaggctgcgaatacgtacagccggaatggcttttcaggattgcaaaagaagaaggaaaagaggcagactggctgttcattcaggaagtgggaggaacccgcttatcagtggaaaaggggctggcctgcgtaaatcatatgctggaagcattaaaaaaagttccccgggtggaaatggggttttcggatcttgtgattggtgcagaatgcggaggcagtgattataccagcggccttgcaggaaatgtggtagtcggcagattttatgataagctggtggatttaggcggcacagcagtttttgaagaaattgtggaagccattggcctagtggatcttttaacctcccgggcagccgatgaaaacgccggaaacgagatccggtatacctatgaaaaagcgctcgattattgcagatccgtgagacagtattccgtaagccccggcaattttgcgggaggactttccaccattgaagaaaagagtatgggcgccgttattaaaagcggtagccgccccatacagggcgtcgtgaaagtgtcagggacggtgccgggaccgggcctatggcttcttgattccacaccggatccctattggatgcagtttggaatcaccaatcccaatgacaatgagggcttgatggatctgatcagctgcggagcccacctggtatttttggtgacggggcggggaaatgtggttggaagtgcggtaagcccgtgtattaaaattaccggaaatcatgagacctaccaccgtatggaagaggacatggattttgatgcaagccctgtattaatgggagaatgcagccaggatgaactggcattaaagctggcttacctggtaaaagaaacagccgcaggtcaaatgacgaaaagtgaagctctgggccacagggaatactttgttccttataaatatcaggaaaagcaggtgactttcaagaggaactgtgaagaataggatcgatcaggaggaatggaacatggctgcatttacgcaacagcagattgaagattttgatataaagaactactactctttaaaagggcagacggccgttgtgacaggaggagctacgggacttggactggcaattacccgatgtcttgttaacgcaggtgccagggtcgttgtgctcagcatggagtctccggagcaggcggctcccgccttggaagagtttggcagccggacagtatattacacgtttaatattacggataccgaccggacacaggagatggcggaccggatccttaaggaacaggggccggtcagtatattgattaataatgcaggaaaccactgtaaaaagttcatatgggaaatgagcgtggaagaatacgtaagcgtactgaatgtccatctggtaggtgcatttgccctgacaaaagcgtttgttccccagatgaaggagctgggacatggacgaatcctgttccaggccagcatgacaagctacatcggacaaccccaggtttccggatattccacagccaaggcaggatatctggggctgattcataccctgactgcagaacttgcagaatttggcatcacagtaaatgccattgccccaggctggatcgatacgcctatgttccataaagcgactgatacggatccggtacgtttcgctaaaatcatgggacgcattcctgcaaaaaccgtaggcgatcctatggatgtgggaatgtgcgctgcgtttctttgcagcgatgcggcgcgctacataagtggaagctgtattcccgtagacggcggtgcattaatcggcttttaaaagaaagggcggtatttaagatgaatacatgttttaatgaggagctttacctcaccaatgagacagggcgcatgttataccataaatatgcggaatcaatgcccatcattgattaccactgtcacctgcagcccagggaaatctacgaaaacaaacaatttgaggatctgggtgagatgtggttgtccggtgaccattataaatggcgggccatgaggacgtttggcatcgaagaacggtacattaccggaaaagaaacgacctattatgaaaagtatttagaatttgccagaatacttccccagttgatcggaaatcctgtttacatctggtgtgcgctggaattaaagcgtttttttgatattaatgaacctctttgtgagaccaatgccaaaaggatttatgaccagacaaaagtcatgatcagggacaagaacatcacaccccgctggtgtatggagcactccaatgtagaactggcaagcaccacagaagatccggtggatgatcttcgctatcatattgctttgaaaaaggagtcttcctttggagtccgggtcatcaccgcattccgtcctgataaggccatgtttgctgccgggaaagggtttcctgcttatatgaaggcactgagcgatgcctcaggcttgacggtaacaagctttggagatatgctggaagcattggagatccggcttagattttttaaagagattacaggaaccacggtatctgatgacggcattccggattttacatgggttgatgcctccaaagaagagattgaagaaatttttacaaaggccatccatggagagtccttaacaaagcttgaagatgacaaataccgcagcgcatttctgtttgaaatggggaagatgtactgccgcaacggatatgtgatgcagctccatatcggaacctatttaaatgcaaacagaaagtatgtagaactggtgggtcagagcaccgggtttgattgtgcagacgattctacaaaaatacagagcgtcggggaacttttaaaccgtctgaatgagattgatctgcttcctaagacgattttatactgtttggatggaacaaatgtggaaaattatgctatacttgcagcagggttttgcgaaaaagctactcgtgcaaaggtacagcttggcgctccatggtggttccatgaccagagctatggcattgaacgccagtttaagtcagtggccaatttatatccggtcagcctgtctgtgggaatgctgacagacagcagaagctttttatcctatccgcgtcatgaactctaccgccgtgtgctgtgcaattatttcggtgaactggcagagcggggtgagtattttggtggggaggaagagctaaaaacgatcattcagaatatctgctattataatgtaaaagagtattttggattttaagtcccacatggtttcgcaaaaggcaaaataatcatggaaagaggaggagcctgatgaagaaaagggctacaatcaaagacatagcaagcctggcaggagtatcacttggaacggttcacctggcactgaacaataaaccgggggtaagtgcggcaacccgtgaccgcatctgtaccctggcgagggagatggattatcatccgaatatagtggcagcatccttaaaaagaaaaactctgcgtctggcagcatgctttccgggtgttgatgaagataaccggttttactatccccagctatggaatggtttgcgtgcctatgtggaaaccttgtatgactataacattaactgccaggaattttcttatccggaaaactggaaggaagagcggttaacaggagcaaaaagcagggcactgaaggaattgacggcccttttggaggctggggagcttgatgggcttgtgatccaggggaacagctgcccgtatacagaggagcagctgcgcagatacgtggaaaacggccttgcacttgctctggttgacacggatatcccggaaagcggacgtttatgctgtgttgcagccgattatgacagcatcggacgcaccatggcagaacaggtatcaggaaggatcccttcctgcggcagcattctgctttgtgctggaaaaatggcatatccttctcatcgcttgattgaaaagggatttgatgattatttgcgtgagaaccaccaccggaatctggtgtacaaagagcattccaatcagattgatgaagaatcttaccagaacattctggcatatattaaccggccggatgtagctgcggcatgctgtgtttcctccagatccagcgtgatgttggggcgggcgctggaagagagcggcagagcaggggagctggtagccgtagggagtgatttatttgtggaaaacaaggaatttcttcgcagaggtacgtttcataatctggttcagaaaaacccttatgcccagtcctttctggcaactaaatttttgatggattatctgcttcgggatatcctcccggatgaactgtttgttgtgggcagtcagatgattttcagaagcaatatggccctgtatgataaaaattcgctgcgctttctggaataagcgcagcttttaggagttgtagaaaaaagatggatcaaacaatacgaaacggacgcatgctggcaggaggctgcgggaatcaggattcttttaacactcagctgctttattttacctgttcctctgtaagccgggatgaggaacggctctatctgatatgcgacaagggtgggaaccccaatgtagtggtccggaacttaatgaccggagaagaaaagacgattacggaaaattataacggtgttttaaaaagctatgtctattttgacggaacctttcaaaaaggactgggaaaggcaagtgtaagtctggattgccagagagatatcatttactttatccaggatgacaaaatttgtaaaacagatgtaaatggaaccatcaccgtattaaatgccgtcccggatggccgtatgacagcgttcacccatgtgagcgcagatggaaaattcctctgtgttcccatgacggatggaagatgcctggattatgatccggaaacggaaggaagcgggctggacaaaagaccggtctataacatagacaaaagagtacaggaggaaaatttaagcagctatttgtgtgtgtatgatacggaaagcggtgagctgctttacgaaaaagaggtgcccagatgctggatcacccatgttcagttcaatccggtcaactcagaggagatcatgtataaccacgaatggccaagcttttcctgcggaatcaggagaatctggctgtatgaccatgtctcggattctatttccccggtgcgtttagaaggaggggatactctgggaaattccaaaggatacagacggacggccgatgactgggtctgccatgagatgtggaccgacgacggaaccgccattgtttatcatggcggctatgcaaacggaccggccatggtggggaaataccagctggaatccggtaagtactgggaaattgcattgccggatgattatgatgcctatgggcattttaccatggaccatgttggaaatctggtttgtgacgggtattttaaatatccttgggaaatgaaaaaggtcagggataacagtacggataacggacctgatcctcacaaaaaggatgccgagtacatatgtaaggtaattccggattgggataagggggaactgaaatggttgcctctttgcaggcatgaaagcgactggctgggccaggatgctcatcctcatccgatttacagccatgcaggtgaccggatcttttttaacagccggatgaataagaacgtaaatgtttattgcgtttcttccaaagaacctcaggcttaaataaaagttatataacaggcgaggcgctgcaatacggctatatcaagaaaagccggggtgcagcgcctttttcacgggttattgttcacttaatttgaattctgattttgcccctggtttatacccccgcttgttgcaaatttaaagtttttcttacaaatatttccatttgcctgaactttgcctgatttggttgacacatggtatcatttgtcattataataaataaatgtataatttacatgtaattggaaattcataaatacaagaggacatattgggagaaacagatgaaaaagtataaaaaagctcgtaagatggccctaattctggccagtgtcctggtgatggactcttatgcgggagttgtttcgccatacataaatgcgtacgcctatacggaaaaggcagcaacggtaaatgccacctcgctgaatgtgagaagcggccctggtacgacctatggcattgttacaaaattaacgaatggggcctccgtgactgtaatcgatgaaaaaaatgcttcggatggagccctttggtatcagatccgggtgtcgggctccggcggacagacggtcaccggatatgtttctaaaagctttcttcggtttccggcgtcctataccaatgatgcagattttgaatcccgtcttacggcagagggatttccggaaagctataaggtgaagctgcgtgctctccatgcccagtatcccaagtgggtgttccgcgcccagcatacgaatctggactggagcacagctgttaaggaggagagccaggcaggaaagaccctggtccacaccaacagcctgtcatcctggaagtccacagtagacggcgcttacaactgggataccagcacatggatcggatacgacggaagcacctgggtcaccgcttctgaagatattgtgaaatattatatggaccccagaaatttccttgatgagaccaatgtattccagtttatgacccatacctatgacagcggcaagcacaggttggaagggttaaagaccatggtaaaggggacgtttttatcgggtgaatctgccggcggaagcagcggtagtgcgccgggcagtacggacagttcttccggcggcggtaccgtcacaggaccgggagcagtggttgggcccggagcagcgatcagtccaaccaccggttcagagccggaatccggttctggttcaggaaatgtaagtctggaagggcctcaggcctccattacgccgaaaaatcttcctatactcatggaatacgggcctggagccacccttacggggccgtcatcctccaatacgactggaacagtcacaggcagcagcgactatgtgaatatgatcatgaatgcggctgcccagtccggggtgaacccttacgttcttgtggccatgatcattcaggagcagggctcttcaggcacaggcaaaagcgtttcaggaacagagcctggatatgaggggtattataatttttttaatatagaagcatatcagtccggaaccatgactgcggtacaaagaggcttatggtgggcatctcagtccggcagttatgaaaggccatggaattcacctgaaaaatcaattttaggcggagctttttattatggtaataactatgtaaaagttgggcaggataccttttatctgaagaagtttaatgtacaggggtccaacttatataaacaccagtatatgaccaatgtacagggagctgcatcagaaggtgctgtttattcaaaggcctataacagtgacatgaaacagacagagcttgaatttaagatccctgtctataacaacatgcccgataatgcctgcagccagcctaccggcgacggaaatcccaacaataagctgtccggtttaagcgtggaaggattcgccatgactcccacctttagccgcgataccctggaatacaacttaatcgtagatcctggcgtatcaaatatcaatgtgtatgcgactcctctcagttccctggcttctgtgggcggaaccggatcgatcgctctttcaagcggcaataatgatataaaggtgtctgttaccgctcaaaacggcagtgtcagacaatacgtccttcatgtggtgcgccagaacaacggccccacctattcttcaggcgtgggcgcaaaccccgacggaagcagttcttccggacaaggcagcagcaccggcagcaatacctcttcaggacctggcagcagcacgggaccgggagtatccaaaccttccggcacggacaatgcgggcacgccggggggaagcaatgtgaccatagcgccggatggctctacgaacatttccgtacagacttctacgggagttatatcccagggacccggaacagacgttaaggtaacggaggctgcttccggcggtccccagcagacacaggcttcttctgctgccgatcagtctgctgcatatacaaaaggtgatatcaatggagacgggaaaataaacagcctggatgttctcaagcttcagcgctaccttcttggcctggaaaccataccggagaagggaaagctggccgctgattttaatggagacggcaaagtgaattctcaggatcttctgcttttgcagaaaaaaatcctcggactttaatgtccggcagaaataggagataatatgaataggaaactgaaaaaactgacggctggtttgatgctggcctgtatgattgccatggccggtcctgccggacagatggtatcctgggccgcagatgccaagatcgcattttccgacccatcggtcatggttgggaacgaagtgacggtaaacatgaaagtgaccagtgacagtgccctgggtacggcggaaatcatgctggcttatgatcccaatattctggaatttgtcagcggaaccaatgcaaacggcggcgcaggggctattaaggttttgggaaccatggattcagccgatcagaaaacctttagctttactttaaaatttaaagcccttcaggcaggaaatacccagatcagcgtaacctcccaggaaatctatgatgtggattcccaggctctttccttaagcaagcaaggaaactcgtcggtaaaggtcacgtcacctgccacgtattcaaaggatgcaactttgaaatcattaaagatttctccgggaacactgactcctgggttttctgcctctgttgacagctatacggcggaggttgacgcaaacacaacggacctggtggtcaatgcggtggcagccaatgccggagcccatgtgacccttcagggcgacaagggcttaaaggccggagaaaaccaggtggttgtaaaagtgaccgctgaggatgggcagacagttaagaattataccattcaggtgaaaaaagcagagggcggagaaacgcctcctgccacagaaggaagctcggaaacgtctgaagctgaattcggagctgtaacggtgaccattgacggaaccgaatacagcattgcttcatcttttgacgaatcagcacttccggaaggctttgaggcagggacctattcctataagggaaccgaagtcatgtccggaaaaggactggaaaaggatcttcttctgctttatttaaaggatgcaggaggaaacggcggattctatatttataacgaaggagcagatacctggtcacagtttgtgcaggtagagactgttgcaaaggccattgttatcattcctcttgacggggatgcggtgattcccgaaggattccgtgaacgccaggccgatattgacggcgtgcgggtcaccagctgggtggaaaactcagaggctgagcctcagtattgtcttttctatgccatgaactggaacggagagaagtatttctaccgttatgatctttccgaaaagaccatccaaagatactatgcttccggggtttccaatgatgaatatgtgaaaatggccaacacatacaatgatctgaccaaagattaccggatgcagttctatattctcattgtggtgagcgtcgttgccctcggccttctggtcgctgtgatcttcctcgtaagaaaaggaagcggatcaggccctggacggaatggcagggatagttcgggaaaaggaagggaaccaaaagcggctgatgacagagtgtgggctgagccggaggaagagatccccacaagcaggatcaaaaggtataccagggaagaatttgacaaagagagctccaaaaccggaagcattaatgcggaaagctccgaaggtgatatccccaaagccaagataagatcggaatatgaggaagaatatatggacgagcttgaatacaggggtgccggagaacaggaagcaaaggaagaggatgattttatcatggaaggaagcttagaagacctggaacgtgatctgtctgcttccgtagaaaagcctccggtgaagcacaaaggaaaggacgacccaaggccggaccataaggaaccgaaacgctttaaggaagccctagagccttcagaggacgaagacgactttgagtttttggatttagatgattaaagaatgataaaagattgaatgataaatagttaaattacaaacaattaaaatgccagtaacgaaagcacctgaatgaaggtgctttcgttataagcttttgttataaaagatcgattattcttattccatacacggtcttccggcccttattgcaatgcatggggaatcttcggattgccagggtgtacataaaaaaaatcaatatataatttatgacatttgaccatataatgaccagcagacagagaacattttacgttaaaaaaggggaatgataccaatccatatttcatgttgaaaaaaacagcggattgtgctattatgtatataacaggtataacgaaagatggtgaaaatatgttcttgcaaattgattttaacagtgatgaagcgatctacatccagcttcggaaccagataatcataggaatcgccaggtcaagtataagagaaggtgaccccctgccttccgtgcgccagatggccgacaacataggtataaatatgcatacggtaaataaggcgtactctgttctgaaacaggaaggatttgtcaagctggaccgccgcaagggtgccgttgtgtccctggacgtggataaaattcaggtccttgatgaaatgcgcagagatttaagcgttgtgcttgccagaggagtctgtaaaaatgtgtcatgtgaagaggttcatcagctggttgacgaaatattccagtcatttttaaaaggccagagtgaagagtgattcactgaattggaggttcattatgttatgtgaaagatgtaagattcgcgaagcaaatatacaatatacagaagttgtaaatggcacaaagaaagaacatcatttctgtgcccaatgtgcaaaagagatggattttggtgtgtacgcagccatttttgacggggagttccccttaggaaagctgctttccggccttttgggaatcgaagacaaatctcaggggcctgataagcttcatcagatcgtttgtccgtcctgcggcaccagctatgatgagtttgtaagagacagcaggtttggctgtgcggactgctacagtgtctttggcccacttatggaggacagcttaaagcagcttcatggaaatctggtccatacgggaaaaacaccggtttaccaaaagccggatcatctgtcgtcagtcttgggaacaggcggaaattccggccaggaaaaggagaactctgcaggcaaggcgccagatcccaaagccatgggtaatcatgaagagatctttcagtgggatgccaaattaaaagaggctttacgctttgaagattatgagacggcagctgtatgccgtgataagataaaagagctgaagaaaggaaatgagacaaatgcttagatggtttgaacagcaggatactggccggcctggaattataagcagcaggatccgcctggtcaggaactgtcaggattaccagtttccttcaactttagatgaaaaggaaggcggtgagctggtccgcaggctggagtttggtttaaaggatttgggaaaggaagaaggcaggaattttgaatttgccatgctcggtgagctggaagaactggaccgggcggcccttagggagcggcggatcttaaattcagcagccgtttccaataaaaagcctgcgggcatccttatctccgagaatgaagatacgggcattgtgtttaattgcgatgaccacataaggatccagcttctccagatgggacttcatctggaagagctttgggaaagggccaacaagatcgatgattacatcaatgaacggtttgcctatgcctttgatgaccgctatgggtatctcacttcctttcccaccaatgttgggaccggtttaagagcaactgtggtggtgcaccttcccatgctgtcacagggaagaaagttccagggccttatcagcgatatgggccgctttggagcctccatcaggggcgttcatggagaaagagacgaaaacttcggttccctttatgaaatatctaatcagaaaaccctgggccagacggaacgggagatcatagatacggtttcaaaggcagccattcagctgaccaaccaggaactttcagtgaggaagctttctctccagaggcaccgggaggagagagaggatgaggtatacaaatcctatggcgtattaaaatattccagaaggctgacctccagggatgccatgattttcttatcacagatcatggcagggctggcagacggcctcattcatacagaggaggagttttccgtctaccgcctgatgcttggaatccagccggcaaatttacagaagatttcggaccgccccttaagcaaggaagaactggatggggccagggcggaattcatcggtcaggaattaccggagctgtaagaaagacgctttgccggtttcttacagatatcgcggcagccgccgaatgaacgcgcaggcatgttcacccggcacgctgcccgcgtaaataaaatgacaggaggattgcatttatgatagacagatttacgacaaaggccaggacggccattaatctggccgtgcagtcggcagaacgtcttggccacagctacgtgggaacggaacacctgctgatcgggcttttagaagaaggcagcggggtggcttccagggttctggaagagaacggggtaaaggaagagaaggttttaaacctgatcagtcagctgattgcccctgatcagtcgcttcatcttaaagaggatggcggatatactcccggagccagaagggttttggagaacagctacagagaagccgtgcggtttaaagcgaacttgatcggcacggaacatttgcttatttccataatccgtgacaatgattgtgtggcttccaggcttttaaataccatagggatcagcattcaaaagctttatatcgatgtgctgtcagccatgggagaagatgctcctgcaaataaagaggaactcatgaaatcgccaaaagcaaagggaagcactcctacccttgacagctacagcagggatttgaccgaactggcagcaaagggaaagcttgatccggtcattggaagggaatcagagatcaagcgcctgatccagatcttaagccgcaggaccaagaataacccgtgcctgatcggagagcctggagtaggtaagaccgcagttgtggaaggcttagcgcagatgataacaggaggtgatgtacctgaaaccattgcaggaaaacggcttttgaccctggatttatccggcatggtggccggttccaaatacaggggagaatttgaagagagaatcaaaaaggtgattgccgaggtgatcgaagatggggacgttcttctgttcattgatgagatccacacgattatcggtgcaggcggagcggaaggtgccattgatgcttccaacattttaaagccgtctctggcaagaggggaactgcagctgatcggtgcaactaccattgaagagtaccggaaatacattgagaaggattctgccctggaacggcgctttcagccggttacagtggaggaaccttccgaggaagccgctgtcagcatattaagagggcttaagggacggtatgaggaccaccatagggtgactattacggacgatgccttaaaggctgcggtaaaactgtcttccaggtatatcaatgaccgcttccttcctgataaggccattgatgtcattgacgaggcctcctcaaaggtgcgcttaaccacatttgtggagcctgcggagatcaaggagctggaagctgagattgagcagctggaggatcagaaggaagctgccatcaaggcggaagcctatgaaaaggcagggactattaagaggaagcaggaaaagaaacgggaaaaaatagaaaagatccgggaacggtggcagaaggaaaaaacttcaaagaaccttattgtagatgagggagagattgctgatgtggtatccagctggaccaagattcccgtcagaaagctggaagaaggggagagcgaacgtctccgtaatcttgaaaccatccttcatgaacgggtgatcggtcaggaggaagcggtcaccgccgtatcaaaggccatacgccggggaagagtaggtcttaaggatcccaaacgccccattggttccttcctgtttttaggtcccacaggcgtgggtaagaccgagctttccaaggctctttccgaggcaatgtttgggacggaaaatgctttgatccgggtagacatgtctgaatacatggagaaacacagcgtttccaagatgatcggctcgcctccaggatacgtaggctatgacgaaggcggacagctcagcgaaaaggtccgcaggaatccctactccgtaattttatttgacgagattgaaaaggcgcatccggatgtgttcaacatcttgctccaggtattggatgacggtcatattacggatgctcagggccggaaaattgattttaagaataccgtcatcatcatgacctctaatgcaggggcagagagcatcatatcacccaaacgcctgggctttggggcggtggccgatgaaaaggctgattataagatcatgaaggaccgggtaatggaggaagtaaagcgtctgtttaagccggaattcattaacaggatcgatgagatcatcgtattccatccgttgaataagacccacatgaaggatatcgtgaccatcatgatgaaggatattatgaagcggacttcagagcagatgagcatcaccctgatggtcgaagaagaggccaaggaatacctgatcaataaaggctatgatcagaaatacggcgcaaggccattaaggcgtaccattcagaactgcctggaggataagctggcagaagagattttaaatggaacggtaaaaacaggagatgaagtcgttgtgactgcaggtgaggacggactaaaattttctgttaaggagctggtaaaatagctagccattttatatcaattcgtgtataatagctacaagcgaaatcatctgttcatcgcaaaaagggataagtaaacaaaatactaggagggcaaaccaatgccggtaattgaagaattaatccgcacagagcaagacgggacgatcagttttgggaattacaaattaaagacaaagtcaaaattgcaggattttgagcacgatggcgatttatataaagtaaagaccttttacgagataaccaagctggaacgtaacggcatgttcgtatacgaatccgtaccgggaacggctgccatgaatttcagcgtatctgatgatggtgtggaatttttggtagaaggcgacaaggatgcccagctgaccattcagctggcagaggatactgagtatgaggtatatgtggctgatgcttccgtgggtggtatgagaacaaacatgagcggaaagctctccatcagcgtggaactgaatgaagaaacgcctgtggcagtgagaatcaaacgaaaataacaggatgagaagctgggttcggctcttttgtaaagagccggacccaggctttttatgtcaggaggaaattcctatggcaaaggggaaaacgaccgcatttttctgcaaggaatgcggatatgaatcagcaaagtggctggggcagtgcccgggctgtaaggaatggaatacatttgtggaagagccctccgggaaaaaggaaccggctgctaagcgggggatcagtggaagcggagtaaggtctgccgcaaatcccattcatgtcaagccgtcccggttgtctgagatccacttggacgagcaggaccggatgaaaaccggatatgaagagctggaccgggttttgggcgggggagttgtgaaaggctctcttgtactggtaggcggtgatcccggcatcggaaagtccaccctgctcttacaggtatgccgcaatctggcggccgacagcaggaaggtcctttacatatccggagaggaatccttaaagcagattaagctgcgggcgaaccggatcggggaagtaaagggggatttgttgtttctttgcgaaaccagcctggaagtgattgaaggggccattgaagaagaaaagcctgatgtggtgatcatcgactccatacagaccatgttccgggaagaaatctcttccgcccccggaagtgtcagccaggtgagagaatccaccaatatcctgatgcagatcgccaagggagccggaattgccatattcatcgtagggcatgtgacaaaagaaggagtggtggccggtccaagagttctggaacatatggttgatacggttttgtattttgagggagacagaagcgcttcttacaggatcattcgcggagtgaagaatcgttttggatctaccaatgagatcggtgtttttgaaatggttgaaagcgggctttcccaggtgaagaatccttcggaatacatgctgagcggaaggccggaggatgcctcaggtgcagtggtggcctgttccatggaggggacaaggcccatgcttttggaggttcaggccctggttactccaacggcttttggtatgccaaggcgtactgccgcgggtacggattataacagggtaaacttactgatggctgttttagaaaaacgatgccattacgatttatctcattttgatgcttatgtgaacattacaggcggtctgcggatgaatgaaccggctctggatttagccattataatggcgatcgtgtccagcatgaaggataaagccgttgatccgaaaaccattatttttggagaagtgggattggccggagaggtgcgggccgtgtccatggcacagcagagagtgagtgaggcgaagaagctgggatttaatacctgcgtgatgccggaaatctccctggaaaagatggggaaggtggaagggatgcgggtgattggtgtcagaaatgtgagagaggcgattgttagggttatggggtgaagccattttgggtggcttcaccctttttttatttgggatattacataccttgtaccgaaagcgtctgcagggctgcttttttatatgtccgtgtgctatgttattcatggatgaaaagattcctctgaaatacggcgttgtcggccaggaaacatgcggcccaggcggaatagcgtatggaatgcgttctattcagggtgttttggatctggttgattacatggaaaaatattcaccggacgcgtggcctcttaactattccaatccggctgccattgtagcagaagctacctgaaggctgcgtccaaaagcaaagattcttaatatttgtgatatgcccatcagcattgaaaataatatgttaaaaattttaggttatgaaaaacgcagtgatatcattaccctgtattatggattaaatcattttggctggtggtatggcgtgaggagcaaagacggaaaagatttaatgcctgaattaaaagaatatgtgaaagacaagggatattttgttccatcagatgatgatggggctaaacagcatggagcttccagctggaatgaaacttaccgtatggcaaaagacatttatgcggttgatccggatacgctgccaaatacgtatttaaagtattatcttttaccggatactgttgtaaagcattccgatatcaattatacaagagcaaaccaggtaatgaataccagggaaaaggaggttttcactgcatgccgtaaaattgcagagaacaaggcgtttgaaggcgatgaattatctgtggatgaacatgatactatgaaagaaatattaacaatgaggtagcatcatgctgattgaagccattaataaaaattatgaaaaattaaatgaatcagacattagaaatgattttctgaacacatgccagcaggtagagtcatctgcgaatctgcttaaaattgcaaaggaaatccgtaagtcacaaaatgttgtctatgggacagggcaggcgcagagtcattgtgcaatggaaatgcagcgtttatttgtgcagatgaataaatatatttattatgtgggcgccagcgatgaactttatatgctgtcaaaaaaccttggacctgatgatctggtgattgtgatttctttgtcaggaaatgtgcagaaaattaaggatactttgcagttgcttcatttgaagaaggtaaaattagtttctattacaaatctacaaagcaatttgttggcgggtatgagtgattatagtttgtatgctgtcagtaatcctgttaagatcggggaacatctttatcataattcttttgctaatttcttgactgttattgagtatgtgtttttgagttatattaaggtgagtgaggggcaatcaccttccatatatttgttttcaacggtattccggaatatatcatacccggacttatcaatgaaaacggatagtcctctgcctcttggcacatctgtcatttcactggaactttcccaatataaacaggaaatttgatttggatttaaacgtatgtatcggaacacatatatttaatcttttttagatataagcaatgaaaggatttctattaccagcataaattagaatatcaggagagaagtaattattttaaatataggatctgctgaattatctgcgctgactttaaaagtcagctgagtcaaattgtcaacaaccttccatgctttgtatttgatttctgttctgatagaagcatcgaatgattctattggatgtatagttgcatacatttatatttccccttctttattaataaaataactaagtttagatccaagatacatgatccgtttatcattcaaatagcaatttacttttgaagctgataaaagcaattaaaacacaacattgatgtttggatatcccggaacacaatatggttccgggcagatacaaaaaggcagaataatcaatcacatgaaggaatgacggagcagttctaaaggataaaacgctgattaagatttatcgatctgttgttaattgctgggcgaataatattttaagaaaaggatgtaaatttaacttcccttatttatctatataatctatttttattctcttacaaatgatataccaatccataataccaacttgggataatgagttcttctgattttttaatagtaaattcctgaaaaggttccaactgatcgaaaattaacagacgtgtacagctggacatattctaaaatataaaggatatagaattctttataatgtttggatatataagaaatcatttgtgaaggggaagtccatatgaattgtcgttatgattctgatgataattattattctggttgtcgtcgttgctgcaattgtggctccacagggccaacgggacccaggggttgtcaaggaccgaggggttgcccaggcccgacagggcctagaggctgtccagggcctacaggcccaacgggcccaataggagcgaccggcccaacgggcccaataggagcgacaggcccaacgggtccaatcggggcgacaggcccaacgggtccaataggggcaaccggcccaacgggcccaataggagcgacaggagcaacgggtcctacgggaccaatcggagcaaccggcccaacgggcccgatcggagcgacaggagcaaccggcccaacgggcccaataggagcaacaggagcaacgggcccgacgggtcccataggagcaaccggggcaaccggcccaacgggcccaataggagcaacgggtccaacaggcccgatcggagcgacaggagcaaccggcccaatcggagcaacaggagcaacggggcccataggagcaaccggggcaaccggcccaaccggtcccattggtctgacgggagacacgggcccaaccggtcccataggtccaaccggagacacaggcccgaccggtcctatcggattggcaggagataccggtccaaccggtcctattggattgacaggagatacggggccaacgggccccattggtctgacaggagataccggcccaaccggagataccggcccaaccggtcccatcggattgaccggagacacgggcccaactggtcccatcggcctgacaggagataccggcccgacaggtccaacaggagatacaggcccgaccggagcgaccggcccaaccggtcccatcggattaacaggagacacgggtccaaccggccccattggtctgaccggagatacaggcccgaccggagatacaggcccaactggtcctatcggattgaccggagacacaggcccaaccggtcccgccggattaaccggagacacaggcccaaccggtcccatcggattaacaggagacacaggcccaaccggtcctatcggcctgacaggagataccggcccgaccggagacacaggcccaactggtcccatcggattaacaggagacacaggcccaaccggtcccatcggattaacaggagacacaggcccaaccggtcccataggtccaacaggagacacaggcccaactggtcctatcggcctgacaggagataccggcccgacaggtccaacaggagataccggcccaaccggtcctatcggtctgacaggagacacaggcccaaccggtcctatcggattaacaggagacacgggtccaaccggtcctatcggcctgacaggagataccggcccgacaggtccaacaggtccaacaggcccaaccggtcctatcggcctgacaggagataccggcccgaccggcccaactggtccaaccggccccatcggcctggcaggggatacgggcccaaccggccctattggattgacaggagatacaggcccgacaggcccaaccggtacaataataagtcctgttattggatttgcggaaaataatactggtgatgatgttaccattaatctagtgacacctacaattattccattaccggatgagcaaacattgtctccagaaattacagctaatggtacaaataccatatttacggttaatgaggctggattataccggattgcgtattatgtcaatatcgttacaccagacagttttgccagcgagcttttaattaatggtacggcatttgtcccgtctattgttgatgtcggcggtgatattaatagtacttcaacagaagtttttgtcactctggccgcaggtgatacggtttcactggctcttcttggagagccggctactctaagcttgagtacaggatctggcgccgttttagttatacagcaaattggtctgacataggaaactgtaaatgtaagataaaacaataaagggcattgcttcggctatgccctttacataattatgataaagataaaaagttctactttttcctcatagggaaaattctgttcaatggaagaagttagtatctgttctttgtacatcatataatagggctggtgttttccgccgtaccaatcactctgatagggtcatcggcctcaatgcagaggataactgtcttagtggaggcatatttttatggcttttatttatagaatcattataaagtgacaatttattttatattgatcacattgtacgcagaatcaattttatttgcagccatgccagacatatgaggcaccaactctgtatggctgccatttttatataattcattattgtgattctataatcagctgttttgttgagaaattttaattgtatggagaaatgatatttctgattatttttggatttatagaattattattagtaaaataattgttaaaattaatatttgacgagatatagggcaatatttataaatattgataataaattagaaagttatctttttctagactgatctttttttgtatattctggtgaaataagataatggttttgctgtaatgatttacaggcttcttaagattataaagtttccctgtcaattatttacaaacaatttacttatctttacgaatacataaatctcattgacttgggactgcttcagattatatactctggctaaattcaaaaataaccaatgcaattataaggaggtcaagatccatgaaaaaaaagtatttagcggttaccgcattatctatggctttaaccataggaagtgctgtgtcatcatttgctgcaggttttgtaaacaccccgcagggggtaaagtacgaatggggatctggcgattactgtacgaacaactgggtccactacaaagaccattggttcttctttggcaatgaccagcttatgcgtaccggctggattcagagggacaacacctggtattacacagctgacactggtgagcttcaggggggaattatgaaaatcaatgacaatgtctactactttgacagcaattccctgaagttagtaaccggtccttacacctataatggagaaacacataactttaccgataatggaaccactgacggtggtccatacgtctacacagaatggaacagtgatggtaccatcaggcgaggcgcaaaatttggtgtccgttaattctgaacattttagaaagagtcaatttcgacttccccctacaggccttatagcagaaggttctgcagggggtttttatatatttcaaggtgtgtttcactggcccgtagggaatcgatatttatcccttatatcaaaatttgacactgaattctcttggcgcgcttggctgcttcaagtcatggaggtttagatcaaagcttcaccaaccgatgatcctgtttacacttttatttcaaagaagcgttctcagggaaagactttctatttctacataaaagccggtgccaatgagtttctgcgcatcaactacggcggataaaggaatactggcttcacttttcttgcttgaatgagttatctatcacagattcactcaaaccagcgttctggtatggccttattatgatactgaaagtacagcataaacttttatgcaaatcctatcggttttttatttaaaggcttgctttggccatcttcctgctgctgacaaagtccgtcaagaattttctaattagatgttctctaataattatttgttatttcaaaaagtcataaatcttgatataatatttgcaatagacaattatggttataactcgtataagagttcgatatgaacgggtgcacattattttatactttatacattagataaaaaagagcagacacggttaagcatttgtttttcgtttgtggtatattgttttagaaagaggaatctatatgcacgcatgggaagccatacaaaaaactctgaactacatcgaagaacatctcaatgaagaaattcaaatcgaagaactggcagaaactgccgtactttcactgttttattatcagagattattcgcacggttggtaaagacatcagttcgagaatatattaaattacgccgattggcgaagtctctcacgatgctgcgtgataaagaaaaccgcattatggatattgcaatggaatatggttttggcagtcacgtaacttttacgcgggcttttaaagaaacctatgggataaccccttcacagtaccgagataaaccgattggtttacagaattttgacaaacccgatttattgcttggttatattgtggttgatgaaggtgtaccgctgattagtgatggattggttttggaaatgaaccgtaaatttctagaagaaccaattgactttcttggtgttaccggatattatccattcaaatacggtaaaatgtttggcgaaagaaccggtgttgacacggttggtgagatttggaacaggtttttcaggggtcttccaaatatctcgcatatctcagaggggcgctggattggtgtttcttatcacggcgatgcaccagacggttattccagttattttgttggtgcagaagtgaaaaaagacgaaaaaatctccggatatacatattggcagctgcccatacgagaatatgccgtctgtggctttgaatcggaaaatcacgaacagatgataattaatttgggtaaggcaatgaaatacactcggttttggcttaaaaaacaaaatctaattgccgatggatttttccctgagatatactataaaagtacgtccgacatctcttatgtagaattgtggattccctttaagaaacgagaaaaataaatagttaatgctggaggaaacgcaaatgagcaattacgaagaaggattaaaattaatcgaagaaaagtttggaaacggcaaagacaatattatttcccttgcgacgatggcacgggagccgggcgctaacggaatgccccgccctgttgtccgtagtgtggacgcttattatgaagatggcgtattttatgttgtaacacatggaaaatcaaacaaaatgcagcaaatctcacaaaattcggaggtttcggtcgggggctgtttagagatgttcaccgctaatggagtaggtgaaaatctcggttgggtgcttgatccaaataatgccggaatcagaaccaaactccgtacagcttttgccgaatggtacgatatggcaaataatgaaaaggatgaaaactgttgcattttagcaatccgtctcactaagggaacattaaacattaatcattgggaaaaattataccatatggattttgtgaataagactgatatggaaaatggaggcatttattaatcagtgaaacatttcaaacgatacgccgggcagttttaaaattatgacagacaatatgtcatacctaatagacgtttgattatctgcattaataaggtcaactgctgatagtaaactttatcagaatttagtgttgtaacttcaggtcatttatattatcctggcatattttttcaaaatggggagtctatgaaaaggactattgcttttgtattaacaatacttatattattctcagaattcgcaactcaaagttatgcattgtcagatccgcaatctgcggcaatacaagcgttgctggatgatgcctgccgcatatcaggtgtgccgggaatgtcaatctcaatacttgctgatgatgaagtgttctacttttcttccgggtatgcagaccgtgaaaagggtttgactgcaggtgaaaatacattatatgagttggcctcggtcagtaaagctttcaccggcatgggtattctgctgttggaagagcaaggtctgctgtcaatgactgattcagtccaaaaatatttaccttggtttacgttaaagtatcaagggaaacctgttgatatgcaaagccttacactcaataactttcttcatcataccagcggcttaacaaatggcaggcatactcaaaacattccacaaggcaatacgccggatttactgcaaaagactgtagaaatgctggcagatgctgaattggcattccctcccggtaaacagtataactatggaaccgttaattatgacgtattgggtctggtaattgagattgtgtcgggacaaagctatgaagactttatgagggaacaggtatttcagccgttaagtcttcaccagacatatgtttataaagatgatgcgttggccaccagacaggtggcacagggctaccgttcctccttttttatgacaactccatataacgcgcctgagtatgccgggaataaacccgcgggttaccttatttcttgtacaaaagatatggctcgttggatgggtatacagatgggtattgtgcaggacatacccgaaatattccatactgttatcgaaaaatcacaccagggtgatatgtctgttcctgctgtcaacaaaatgtattatgcggcgggctggtcggtaaacgccgaccaaacgattatagagcacccaggggcaatcccaatttcagaaccgaagtggtcataatgcaaggtgaacaaacagccgtctgtttgctgactaacggcgcaaataccaatactaacctggtactaaagattaaagagatattagacggtaatctgacgcagtcatatgtaataagcggcacacagcttttggacatcattttatcgtctgccacaattattttttgcctattggctgttttgttctttctcttaggattacgcagaaggaaaatgaatgagcggcagccaatgacaataaagagaataatcattacggttattttactgatcgctgcgattgccctgtttatagtgtgctgtgccttggattggtcaacaatacttatttggcaaacctatagtattcttacagctttgatttcgtcggcattattgacagcaagcattgcgtggtttatatacacgtaccaatatcatgcctcactccgaaaataagcttaagcaataaaatttcattttaacatcatcaagctgcaatagcagctataaggtgatacccggataagcgccctgaggaaatagtggaaaggtgaaggtgaccttaagatttcaggaacaggtgaaggtttgggtgaaagaaccatagtttattagaccgggttttgtccccactttccatatgaaaaataaaaaagcctggaaatcattgttttacaacaatttccaggtttttatggaattttatttagcaggggaagaggggctcgaacccccatttacggttttggagaccgttgctctaccattgaactattcccctatggatcagcgttttgttcctgtctgagcacttagagagtatagcatagaagcatttaaattgcaacagtttttaggaaaaaataaaaaattaattatgctgttattgaatgcctgtttgtggtaaaatagtatgaaataggaagtctccgggcggaaattacgttccggcggcttgatttggcgttttatatgaaaatagcaagacaaaatcgtgaaattgaattagaatgaaaagaatatttgataatgattcccaaaataaaacttgtctcattaaaaatatgcttatctacaaagctttccctaaaaaataattacaggttatgcacaaaaaagggtcatataattgtgtatgaaacataatttgacaaatcgtgtcaaacgtgatatatataatctataactttttcttcattataaaaaggagttgtgattatgaaacagtttaagattatgttgccaactgttgctgaggcgaaaaagtttgttgctgctgctgcaaaatgtgattttgacatagacgtgtattacaatagagtaacaattgacgcaaagtctatattaggagtattgagtttagatttgacacaggttttgaccgttgaatttaacggggataatgcagagtttgaggcatttctggaagcgaaagctcctggcaagtgttcagcagcataaacatacgcaacgtagaaagggaattgtatgccccatggcctgcagttctctttttttattcatagaaaatttcttcctgtaaatgaaaggaatcagatcaataaggaatagaccgtagaaggaatgaaaggagaggctgccggagtggaagagaaagagaagaaaatcctgaaaatatccgtcaggaatttagtggagcttgttctgcgctccggtgacttagataaccggcggaccggaggggctgagaaaaccgccatgcaggaggggagccggatacaccggaagatccagcggcgcatgggagcggattaccgggctgaggtggtgctaaagcatgaggtggaagtggatcagtttcaaattctggtggaggggcgggccgacggcatcatagagaagccggaaggggtgaccattgatgagatcaagggcatttatatggacctctcctatctgtcggagccctttcccgtacatttggcccaggctatgtgctatgggtatttttactgttttgaccatcagcgaaacggtgccgtcatacagatgacctactgcaatattgaaacagaggaaatccggcgttttttagtggaaaaatcctttgaagagctggaaacctggtttcaggattgattcatgagtacatgaaatgggcaagatatttatataaccatgaaataagaagagatgagtccataaaggagctttcttttccctatccctaccgaaaagggcagcgggagcttgtggtggccgtttaccgtagtattgccagaaagaggaatctttttatccaggcgcccacagggatcggaaagacgctttccaccgtttatccggccataaaggccattggggaaggacttggggacaagctgttttatctgactgcaaaaaccattacaagaggcgtggcggaagaggcccttgatattttaagagatcatggtctgtatctgaacacagtgaccataacagccaaggaaaaactttgttttcttgagactccggaatgcaatcctgatgcatgcccctatgcaaaggggcattttgaccgggtgggagatgcggtctatgacatcatccacaaagaggcgggatcaccagagaagtggtgcttcggtacgcagcaggataccaggtatgcccctttgaattctgcctggatatcagcaattgggtggattctattatctgcgactataattacgtatttgatcccaatatccgtctgaagcggtatttttctgaaggcatttccggagattatctgtttttgacggatgaggcccataatctggtgccaagagccagggaaatgtacagtgcggctgtttataaggaggactttcttcttattaaaaagatattaaagcccatgaaccagaagcttgtcagaatgctggatcggtgcaacaaagagcttctggaaatgaagcgggaatgtgagagctatctgatactggaagacatccggttttttatgaccggcatcatgactcttttcggtgaaatggaaaagcttttagaagcaagcgaggaattccaggacagggacctggttctggatttctattttaatctccgggatcttataaatatttacgaccgtttggatgacaattaccggatctatacagagcttttgcctgatgggcgctttatgctcaggctgttttgtgttaatccggcaaaaaatttaaaagaatgtctggacaagggaaacagtaccgtgtttttttctgccacgcttcttccggtccggtattacaaggagctgttaagcggtgatcaggaagaatatgcggtatatgcccattccccctttgaccaggagaaacggcttctcatggttgcctctgatgtcagcagccgctataccagaagaaaccgccgggagtatcagaaggtggtggattatatggaagggatcgtatcagcccataaagggaactacatggtgtttttgccgtcttaccaatatttgagagaaatagaggccatcctggaagaaaaggaagggctgaaacaggagtttacctatatgtcccaggcctcccacatgagcgaacaggagcgggaggaatttcttaaagagttttcagaagaacggaaggattcctttgtggccctctgcgtcatgggaggagtattttcagaaggaattgatttaaaggaaggacgtctgatcggggccataatcgttggcaccggccttcccatggtctgcacggaacaggagatcctgaagggatattttgatgccagagaacaaaacggctttgattacgcctatcagtatccgggatgaacaaggtcatgcaggcagcaggaagagtgatccgcacggttcgtgatgagggtattattgcattgcttgatgaacgttttttaaagtctgactaccagggactgtttccaagggaatgggaaggatattatgaggtgcagttaaaaaatgtgggagaagttgtccggaacttttggacaaggcgggaatcggatacctcatagtaagctgcaaagtatccgaccctggaagatgcagcccaatgaatatataatgtccaccctgccagcagcccccataaataaaagctgccgcccaaaggggggcggcagcggaatgtctgttacaggggccaagcatgtccatgaactgcttggaagcctgggaaacggggatgttttcattataggcaactaccatctgacgggtgggcagcttttcagaaagctttacctggaataagtccttgtcattttcaggaatgcaaaaatcagggacaaatgcgattccaaggccgatgcgggctaagtcgatcagaagatcattgctgcttaactcgatttcagggaccaggtcaagctgctccttctggaacatgtggtgaaggaattcgctggtggtgctttttctctccagcatcagaatgggatacgtctgaagggtctggaggcttacggtctgcccctttaaaggaaaatattcctggttcgccacgaacacatcagaaaattcattgatgacccgggtgttctgggagcttaacagtccggagtttggataattggtaatgataaaatccacctggcctgtttccagaagatgagcgcattcgatggaggtctggttagtgaccttaatgtgcacgttgggatagcttttatgaaatttatttaaatatggaaccagatagtaacggcagatggtgtcgctggcaccgatgcgaagctggccgccgtttagggtattggcctccagcagctggttttctcccttttggatcaggttaatagccggttctatgtgctttaggaggatatctccttccggagtaagctggacctttttcgtgcttcggacaaaaagggtctggttcagctttttctccagcaccttgatggattggctgactgcagactgggagatgaaaagctgtttggatgcctccgaaaagcttaaggtggcggcaacgtggtaaaagactttataaagttcgtaattaatatccatgatattcctcctcggcataattcacttaatgaaggcaaaggaagtgcagcctggatttcgtgaatcagccgttcaatgagccaaaggcgaattgaacttccttgcaaatataggaagattctatcatggacttgattggtttgtaaaggcgtttgacaaatttcctggggtgctgtatagtaactggcacagaaccaggctataaaaaggaaggagtaaaataaacatatgcatgatgatttttaccagatgtatctggaagagatgggaaatatccctccctgtacaaaggaagagcagagaacgcttataaaggaagcagcagagggcgggaaggaagctaagaagaggcttgtggaaggaaacttacaggctgctctggaatatgccagggaatatgacggcagaggcgtacttttgacggatcttgttcaggaagccaatatggctctaatgatggctgtggaagagtacatccggatggaggatggaacggagtttgatacattcaccggcaagaagatcagggaagctcttgaagcggttgtggaggaagaacagtccgctgaccggaccggagaagagctggccgcccgggtgaatgtgctccagcaggtttcaaaggttcttgcaggggaactgggtcgggaggctacagtggaagaactggcgaataagatgaagatgacagtggaagaaataaaggggatcatgaagattgcaatggatgccatgagcataaatgcggaaaccatggacttggaagcactggcagaagtggaaggaattgaaatcactgaagctgaagaagacgcagattatgattacgaagtataagagactgggagagatgagatgaaaatatatctgatacgccatggacagacggactggaacatccaaggcaggatccaggggagtcatgacattccccttaatgaagcgggacaaaggcaggcggagcaggtggcaaaaggcatggattcccgccgggtttccagggttttttccagtacgttaacccgtgccgtggaaacagctgaaaaaatcggcagcaggcaaaaggcagagatatattctatgcctcagctgattgaagtagagttcggcaaatgggaaggcatgacatgggaggagatcatggaagcgtatccaaaggaatacaggttatgggctttaaaccctgatgaggtggcccctcccggcggagagacccaggatcaggtcataagccgctgtgcgcatgccataaaggagattttaagaatcaccggcggcagagaggatgttgccatcgtttcccacggggctaccatcgcttatctgatttcttatatgatgcgcaatgatccggatatagaaagcattattgtggagaatgccagcatcacgactgtcaattacagtcctttgacagaggatttcatgctgctggaaatgaatgatacttctcatatagcagaagaataaagggatatccttctttataaaaagcggaaaataaaagaagcaagggagccttttaaggtgccttgcttctcttgaaccggtacttaatcaaacagtgtttctatgaggattttcaccatggaaggtgtggtgcggatatacagcttgtctcttcctgcacagcgcagggaagtctgcaaaaggacctcctttgaagcggaatcgtcaaatatactgaccatattggcgcaggattccacaatagagctaagctgtccggccttttcaataaaccgttcaatgtgctcctcactaagctggagacagacctccagatggggactttgctcctctgtttttaagcgggcgttttcaaatgaatatttgtgggataagtcccttagttgttgattaagatccatataatctagcactcctttgttgaagaatcttttattactatattgtaaatttttcaaattttcaagtatttttagaaaaaaatgacgatttctgtcgaaaggtgtcgaaagcaaaaaagggatcagatcatgtatggggtggggagatgatttttttctgctcattggatcaattacattatctatgctaattaatataataagatatattaatttttctaatttatatgttctgtggtatgatgattacatgagaataacagggaagttcctgccctgatggaccaaggggagcttttgcgaggaggaaatcatgagtgtaagaagagtgtatgttgagaaaaaaacagcctatgccgtgaaggcaaatgaattaagagaggaaatcacaggatatcttggtatcaatacggtgaccggtgtgagggtgctgatccgctacgatatggaggctctgtctgatgaagtctatgggctgtctcttacctctgttttctcggaacccccgttggatgaggtatatgaggaagatttccccaaaaaggaaggggatgtggtctttaccgtagaataccttccgggccagtttgaccagcgggccgattcggcagaacagtgtgtaaagctgttaaaggaagatgaggagcccgtgattaagtccgccgtcacatatgtgatttccggtgtgcttacggaagatcaggcggcagatattaaatccttctgcattaatccggtggattccagggaagctgacgaaaaaaagccggaaacacttgcagcagtatttgaaaccccggaagatgtgattgtttttcacggttttaaagagcttgcagaagaggcattagaggaattatacgagtccttgaatctggcaatgacctttcaggatttccttcatatccagaactactataaggatgaagagcatagagacccatccatgacggagataagggttctggatacctattggtcggatcactgccgccataccacctttcagacagaattaaaggatgtggcatttaagccaggggattacaggaagccaatggaggatacctacaaacagtatcttgctgaccgggaagtggttttaaagggaaagagcggaaagttcgtatgccttatggatctggctcttttggcaatgaaaaagcttcgtatggagggaaaggtggaggacttagaggtatccgatgagatcaatgcctgcagcattgtggttcctgtcctcatcgacggggcagaagaggaatggctggtgaattttaaaaatgagacccacaaccatcccacagagatcgagcccttcggcggtgcggccacctgccttgggggagccatccgtgacccgctttccggccgtacttatgtatatcaggcgatgcgggtgaccggcgcggccaaccctgcaagacctttgaatgagacgttaaagggaagctgcctcagagaaagatcgtgaccggagcggccagcggctacagctcctacggaaatcagatcggcctggccaccggatatgtgaaggaaatctatcatccggattatgtggcaaagagaatggaaataggggcagtcataggcgcagctccaaggaaaaatgtcatccgggagacttcggatccgggagatatgatcattcttcttggaggccgtaccggacgggacggctgcggcggagccaccggctcttccaaggtccatacggaagcttccattgagacgtgcggggcagaggttcagaagggaaatgcacctacggaacgcaagatccagcgcttattccgcagggaagaagtgagcaggatcattaagaagtgcaatgatttcggggccggcggagtgtccgtcgccataggagagctggcagacggcttaaggatcgacttagacaaggtaccaaagaagtacgcagggcttgacggcacggaaatcgctatttccgagtcccaggaacgcatggcggtggtagttgatcctgaggatggggaccggttcctggcctatgcggcagaggaaaacttagaagcagtggcagtggccgttgtaaccgaagagccaagactggtgatgaactggagaggaaagaccattgtaaacatcagccgccgttttttggacaccaacggtgcccatcaggaggcttcggttgttgtggaggttcctgacaaagaaagaagtgcctttgtaagacgggagatccccgatgtgagggaggcctggttagggctgctttccgatcaaaacgtgtgctcccagaagggtcttgtagaaatgtttgacagctccataggggcagggagcgtattcatgccttatggaggcagatatcagctgacggaaactcaggcaatggttgcaaagcttccggtgcttcatgggagaacggataccgttaccatgatgagctatggctttgatccctgtttgtcaagctggagcccctatcatggcgcagtttatgcagtattgtcctctgttgctaaaattgtggcagcaggaggtgactatagaaagatacgtttcaccttccaggagtatttccgcaggatgacagaagatccgtcccgctggagccagcctttttccgccctccttggggcttacagcgcccagattggattcggccttccttctatcggaggaaaggacagcatgtcaggaaccttccgcgacatggatgttccgccgacccttgtttcctttgccgtggatgttgctgacaggaagcatgtcatcaccccggaatttaagaaggcgggaagcaggatcgccgtattccgggttgagagggattcctacgatcttcctttgtacagccaggtcatgaaggggtatggagcgctgtttgaggatatttgcgcgggccggatcctatcagcctatgctgtagaaggccatggaatttgtgaggcggtcagcaaaatggcatttggaaaccggctgggcgtgaagatcgaacacaacgtggaccggggagatttcttccggtccggctggggagatatcatatgtgaggtcccggaaggaaagctcggcgaactggcggtttcctatacggtcataggggaagtgacggattccggcgtgtttgaatattgcagtacatccatagccattgatgaggcgctggaggcatggacaaagcctttggaagacgtgttcccaacgtcatcaggagcggataaggcaactgttgcagagcggatttataatacaaaggatatttacgtatgtaaaaacaaggtggcaaagcccagcgtattcatccccgtatttcctggtacaaactgtgagtatgacagtacaagagcctttgaacgggcgggggccaatgtggtgacaaaggtatttcggaatttgacggcccaggatatcagagaatctgtggaagcttaccgcagtgaaatatcaaaagctcagatcgtcatgtttcccggaggattttccgcaggggatgaacctgacggctctgccaagttctttgccaccgtattccggaaccaggtggttaaagatgagatcatgaagcttttaaatgaacgggatggcctgatgctggggatctgcaacggcttccaggccctgatcaagctggggcttgtgccggaaggaatgatcgggccgcagggggaggattctcccacgctggcaatgaacaccattggccgtcacatttccaaaatggtttatacgaaagtggtcacaaataaatcgccttggctttcaggtgctgaattaggcggcatttactgcaatccggcttctcatggggaagggcgttttgtcgcaaatgaggaatggatcaagaggctgtttgacaatggccaggtggccacccaatatgtggatgacaagggctgtcccaccatggatgaaagctggaaccctaacggatcctatatggcgattgagggcattacaagtccggatgggcgggtcctgggcaagatggcacattccgaacgccagggtgaggcggttgccatgaacatttacggagagcaggatatgaagatttttgaatccggtgtgaaatatttccagtgagcgggcattcctgtgccctgcctattactcacagaaataatccataaaaaacagaatatacagaataaatgggcatcctttctgcagacaggcatttgcagaagggatgctttttctttgtgctcctgaaattgtaacactttttaacggccggatgagagtatctccacttgacattcaagaaatttaagcctatgattcatcaggtatatttttattgatattcagacaattggcaatactaaaaattaagaaagattatatgtcagagaggatattggatatgggttcaaagagaaagataaaaaatatattgctgggaaatacgctgaaaagcattgaactggaaggggaaaagctgggacccttttggggagtgcctattatggcaagtgatgcggtttcctcagtggcttatgcaattgaggaaatgctgctggttctggttcctgtcctgggactgtcagcggttcattatcttgggtacgtcacctcgcccattatactgctgtttttagttttggcattttcctattcacagatcattgcaaattaccccaacggcggcggtgcatatatcgtatctgctgaaaacatcggaagaggcgcgtcaatggtagccgcatcttccctgatcattggttatgtgatgacagtagcagtcagcttatcggcggcaacggcagctctcatatccgcttttccggaatttgcagattaccggctgctgttcgccctgcttttcctatgtatcgttacccttctgaacctcaggggaatgagagaatcatccaagctttttgggatacccacttacgcatttatcgtcatcatgctggctcttattgtaaccggttttgcaaagcttataaccgggaacttgccgccggtccattatccggataatttacagactgtttcaggcggcgcagggactgtttccctgtttcttcttctcagagcgttttcttccggttgttcggcgttaacgggagtggaggtagtgagcaatgcggtcccaagctttcgtgaaccgtcacagaaaaacgccaagcatgtactgtttattctggtagggatcattgtggccatttttggcggagcagtgcttctggtcacttccttgggaatcattcccttagaggggaaaaccgtgatttcccagatgggcatggccatattcgggcctgggccgatgttttatattctgcagtttgccacctcccttattttattgctggcggcaaatactgcatataatggtctgcctacgctgttggccatcctggctgctgatggattcgtgccccgccagttcatgcacagagggacaaggcttagcttttccaatgggattttgttcattttttttgtggcggcatttctgctggtggtttttaaggcggaaacccattatctgatccctctttatgccatcggagtattcctgtcctttaccttgtcccagagcgggatggtgatcagatggatccgggtgaagggaaaaggttattggtataaaatgttcataaacggcctgggcgctcttatgaccggtaccggaacggtgattgtatttgtaaccaggtttgcccagggctcctgggctctggcaattattatacctgtgatcgtttttattatgcaccgcattgacgtccattatcagtttgtgggccggcagctggcagtcaacgactttatgtcccattatcacaaaagcaccagccatgacaccaatctctgtattgtcctggccggcggaatcaaccgttctgtgctgaaagctctgaattatgcaaatctgatcacttccaacgtggttgcccttcacgtggctacagatgagaggcagtgtgaacagcttcagaaaaaatggaaggaaacaggcattgatataccccttgaggtcatcatgtccccttaccgggagcttattgagcctgtggaagagtacatcagcaaaaaggaagctgatctgccaccggggatatgatcacggtcgttatgtcccgctttatggaagagagctggtttgcaaatatactccataaccagactacttatttcattatgcagaggctcaggaagcacagaaatgtttccatggtcctggttccatacctttacagtacggcgtttaagcctgcttcaaaggagaaaagcgaaatggttaataaaggcggtgtttaaaggcaggcgaggaagcctgctttatacctgaagcggcagatacacttcaatgtaattgatggatgtatctgcttttatttcctggtgttcctttgtgttatccttaaaggcacagcttaataagtgcccgctgtaggcggtgcccacaggggaatatttgtttttccttgcccagtctgctgcttcccaaactgcctgtgactccagcaccgggctgtctgaggcgatcacggtataaacgcagcgttcctgcttcaataaaggataaccgtttaatgcctgcttcattttcatgatggatacggtatcttcagcgatcatgaagaattcgtttacctggtccgcgcaatggtcattgatctggtattcctggcagatataacataagtcggagaggcccctttgattgataaaacggttatccggcatctggtaatagggggcatgggccgtaaatcatagcggtttaggcattgttccacgtttttataatgtttctgtaaatgcttcagatggatgagggactgccggtgcctttccacctgttgtttttcctccgtaattttttcctggatcatggaacagtaggaagggaaagagcttttatacaggatccggccgatatcctcaatgctgaagttcagtctccggtaaaacatgatgcttgaaagctttttaatatcttcgtatgtataggttcgatagccgtttttttgcttttccggttgtatgatcccctttttttcataaaagcgaagggtatcccggcttaggcccaagcggctggaaacttctccaatggtgtactttttcatgataattcctctctttagtccgaagtgcagcgagtgaatccgctggactcactcgctcacgggcgttcgccctatgaaactgggcaggatagaattttcttacgtggatagtttaccataaaatagcctgtttttggctttaaggttttctttctatgcttacgaattattaacagaaaggagcttgaaatcgtaaagaactatgttatgatagaatcagaaataaagcttatacttacataagagacgtaagaagggagtacttttacatggaaaaaagcaagaggaaaatggtaaaatgtctggtgtgcggagctgtgtttgaagaaggaaatgaggtctgtccggtctgcggagtgggtttagaaaattttgttccttatgaggaagaagaaaggaattatcataaagatacggaggaattatatcttatactgggcaacggggcggcaggtgtcagtgcggcggaggcgatccgtgagagaaattccacctgttccattgttatggtgacaaaggaagattgtctgccttattccaggccaatgctgacaaagtccgtgatgggcaaggatgagagggaagaactgcttcttcatgacccggcctggtatgaagaacggaatatattaaaccttacggggaaacaggcggagaaaatcgacatcagggaaaaagaggtcacctttgacgatggaatccggcttaaatatgacaaatgcatttatgccctgggatcggaatgcttcattcctcctatttcaggaaatgaaaaggaggaagtggttgccatacgccgcctttctgatattgaaaaaatcaattcccttctttcaaaatcaaagcaggccgtggtcatcggcggcggtgtgctgggattagaggcggcatgggaactgaaaaaggcgggactttccgtgacggtgctggagcagggaacttatcttatgaagcggcagcttgatgaggaagccggagagtttttaaagaccatcatcctggagaaagggattgatgtgaaattccaggcagctacccgggagatcgaaggggaagacagggtgacaggcgtccgcctggaagacggcacggtcctgccggcagatttagtggtcatatccgccggagtccgggccaatgtatccctggcagaagatgcaggggcaaaatcaggacgggccgtgatggtaaataaacacatggaaaccacagtacccggtatttatgcatgcggtgattgtgcggaatatgagggaatcaattatgccatctggccccaggccgtggagatgggaaaggcagcaggagccaatgcagccggagagaagatttcctataaaaccgtaacagccgccctcacatttaatggcatggatacttccctgtttgcagttggggatgcaggaaaagatccgggaaaaacctatgaggtacgcagggaagcggatgaggagaggcagactcttaaggcatattactatgagtccggcaagctggtgggcgccatactcatcggtgacacatcggacatgggaagaatcttagaagagattgaataaacagttaataaagaggtgcacaggtccttaccgggacctttgcacctcttatcatctttcttttattccaccgagatctggtatttttcaagccagtaattgatctgaaggatataagcaagcatctgtgggcctgccatgagctgaccgtaccagggctttccgtaatcagaagggctggtcaagagtttttccagcttctttgcatccagaaactccatggcaggagcggaaccgcctgccatcatttctcttacccgcttgattaaaagggcttcgtaatttgtgtcataagttttgggatatggggatttcctgcggaacaggatttcatcaggcagaagcccttttccagcctggcgaaggagacttttaacgaccccatcccttgtttttatgtcccagggaacattccacacgtattcgatgatccggtggtctgcaaagggaactctggcctcaaggccggaatacatgctgtcacggtccatgcggttcagcagggtctgcataaaccagcggagatttaaataggagatttctcttcttcttgcctctttgggattatccccgggaagcacaggcgtttccgctacggacttttcataagtttccagcacatattcatccattttaagatagtccaggaagtcatcctttaagacggccttccgtgttcccaaatccatggtccaggggaaggtatgggccttaaagcactcctccttatgaaaccaggggtatcctccgaatatttcatctgcacactctccggtcaaggtcaccttattataccctttgaccagggagcagaagtggagtaaggaagagtcaatgtctcccatggcaggcagatcatgggccaggacggagtcataaagccggtcggcctgggttacgttgtcacattccagataatgatggtcggagtctaaaaattttaccatctgatccacaaagggacggtcaagggagggctgaaaggtgctggctttaaagtatttgtcattgtttacaaaatcaaaggaaaaggtggtaagccttttgccctgctttttaagctctgcggcacaaactgccgaaaccaggctggaatccacgcctcctgacaaaaaggtgcagatgggaacatcggaaaccatttggcggcggatagagtcctggaccagaaaggaggtcttttcaatggtttcttcatagctgtcctcatgaggtttgctctccagcttccagtagcattttaagcggaaaccctctccggaacagagcagcatgtggcccgggagcacttcatcgattcctttaaagaccccgcatccggaagtatgggccggccctaaggagaaaatctcgtttaagcctttccggtctaaaaccggccgtatgcctggatatgcaaaaattcctttcagctcagacgcaaagatgatttcttcattccgtatggtgtaaaagagaggctttacgccggaacggtcccggcagagacataagtgttcccggaatgggtccatgattgcaaaggcgaagatgccgtttagctgctttacaaaatcaggcccgtattccatatatccggtcaaaatcacctctgtgtcagaggtggtggaaaagaaatggccccgggttattaagtcccggcgaagctcgtttgtattgtaaatctctccgttgtatacaattccaaaggttttgcctgcctcagtctttgttatgggctggcggccggtggttaagtcgatgatggataaacgggcgtgggacagacctccctgtttaaagagccaggttcctgaatcgtcaggtccccggtgtctctggatttctgacatttgctccagaatattcacgtaatgggatttatctttcaggtaatcgtgattcggattgtaaaaaccagcaattccgcacatggaaatccctccttaaagctggaccatctatagaagaaaacaagcggcgataaaagtagcaagaaaaccgatcatgaccggaggaagattttttctggcaagctctaagggatttacgctgcaaatggctgcaacgggtataagtccccagggaacaatggtgccgcctcctacaaaaatcgcggcgatctggcccagggaagccagaaccgggacagaggcccccactgccgtgccaaaggtgtttgccaatgcgccggtgagaggaaggccggaaaagcctgaaccatccagtcccgttaagccgccgataaccagctggaaaaatgcagccatatatttgttaagaggcacattatgagccagccagattgcccagtcattcataatccctctttgaaactgatctcccatgatggtggaaattccctctcctcctaaaaagaaaaaggctccgatgatgatgacgggagcaaagatccgtatggcaaagagaaagccttcggtaacataggaggttactttttccagagaatgccttccaaagcctaaaactgctccaatacccatgaccaggacggctgtgccggaaaccatgcttgtggcctcccctccctttaggtcaaaagccagcataagaaggatgtcggccaagaaaaacagggggtcaggatcgccattatgatggcggcggttccggtatcaggacgttcttcggtattctgaatatggacttcctgacagcaggcagagatcccgctcctgtttaacagatatgcggaaacaacggtaacaatgcccattaccagaaacaaaggccgtccctttgtcaggatgtcggaggttgaaatggaggctgctcctgcggaaatggccggtgcgccctggatgacaaagtcgtagcttaaagcgattccatgaccgaataagttcatggacatggcggctgccaggggatccagaccggctttgactgcaaaaggaagcatgatggccccgaccaaagctacggatgggaaggccagagaaagagggaaaataccagcatggtaccgcccaggatccaccaggtaagggaaggagatttcatgacctttgacatgggtatcatcatcagataatcgcttcctaagtcctttaagcatttggacagtgccgtgacaagggcaatggtggcaataatctccataaactctttggaagcatacaagatggcgttgaacacggtcataatgcctcccgccagggacctaaggcctacaaagccaagaaggaagagaaaaaggaggcagaccaggggcgtatcctttcggagaaccatgacggcaaggatcacaatgacgccaatgagatagatatagtgcagaggtgtaagcaccagataaggatcaaacataggaaccactcctgtgaaaataatataatctatactatgacacaggggaaaggacagtgtgatttttttttcggcagaacttgaaattttcctttctgccttttatacttggttttataaaggagaggcctatgcaaataacgtcggtacatattaaaaattttaaatccatacgggatatggaaattcaaagcgtagaaaatgccctgatactggtgggaaagaacaatacaggaaagacagggatcctggatgccatacgggcagcagcaggagcctatgagattacagaagaagattttaacgaaaaaaagcagaatatagagattaccatgaccctggccattacgccggaggatctggcctcttttcacagaggcggggtggtaagccagtataagaggtttgaggcatggctacatgattttgaatcaaaactgccttcttatcgtaacggaagcctgtcttttacctatcaggtaaactggaatggggttgttcggtttaaggatgggtacaggaagaataaccggtatatcagggatatttttcccaggctttattacattgactcggaacgggatttagaccagtttcaaaacgatcttctgctttttcaggaggatgaacagttggtgaaactgaggacccatgtttgtatgtttgacggtgcaagggaatgcaaccagtgctttaaatgtattgggctgatcaaccagaagaagccggaggacctgcagatttatgagactgcaaagctcctggaatataagatgtaccagctgaacttaaatgattttgctgaaaaggtcaatgaaaactacagaaaaaacggcggttatgaggaaatccgcttttccttaaactgcaatccccgggagatgtttaaagtcgcggcagagacttatcatgcggagagagggaagttaagccccatcaataatttgagcaatggcatgaaaagcctttacatgctgtctcttttggagacctacacagaggatgaaaagcggattcccagcgttgttatcgtagaggaccctgagattttccttcatccccagcttcagaaaatatccagcgaaatcctttaccggttatccaagaagaatcaggtgatttttaccacccattcccccggaatgctgtttaacttcaccagccgccagatcagacaggtggtgctggatagagacggctattccgttgtcagggacagaaccgatattgatgccattttagatgatttaggctatggcgccaacgattttttaggagtcagctttgtgttcattgtggagggcaagcaggataagagccgtctgccccttttgctggaaaaatattattcggaaatccatgataaagaaggaaatttgtccagaatttccatcatcacaaccaacagctgtaccaatataaagacctatgccaatttaaaatacatgaatcaggtgtatttaagagaccagttcctgatgatccgggatggggatggaaagaatcctgaggaactggcgggccagctttgccggtattatgacgagcgcagtttagaggacatcgataagctgccaaaggtcaccagaaggaatgtgcttattttaaaatactattcttttgagaattattttttaaatcccaaagtcatggctgagcttggagtggtggaaagtgaagaagccttttaccggactctgtttgagaaatggaaggagtatcttttccggttaaagagcgggagacagtttgtggagacagtaggtaaggatatggaatcaatggaggatttaaaggcttatatggaggaatttaagatttatatgcggggccataacctgtatgatattttttacgggccttataaaaagcaggaaggggagctgttgaagaaatacattgatctggctccccgggaagattttaaagatattttagatgccattgataagttcgtttattttgaaagcagaaaggcagaggcatgagattattcatctaaatcgatttcccagtccctgaaatagtacttcatatcccgctgtccgatttctcttatgactctgcaggggcttccataggctactgcattggcgggaatatcttttgtcactacgcttccggctccgatcacgctgttttcaccgatgagtacgccgggaaggatgatggccccggccccgatccatacattgtcttcgatggtaacggggacgttaaactggatctgcttcttgcggatatcggggcggatgggatgggcggcagtgtccaccacaacgttcgggccgaacatgacgttgtttccgatgtggatatcggcgtcatccacaagggttaagttaaagtttgcataaacgtcattccccatatggacgtgcttgccccagttggcgtggaggggaggctctatgtaacagtttgctccgatttcggcaaagagctttttcaggatatcctgccgcttccggctctcggaaggacgggtttgattgaagtcgtaaagggtttccaggcaggcggtttgttctgccatcagggactcgtcaacgcagttgtaaagttttccgcttctcattttttctcttaaatccatataaacctcctcaatgtacgggggctgtcggattgacagcctcttttttatttattataacctgtacatgggtggatgtctatgagatcagatgacctgcagcaggttaaggaggatctggcttttgggtttattgtgcaagaaagtgctatcagttggacaaataaaagcacgcttttttcatgcaggtatattataatcagattaagagatcttttgaggaggtatcaggatgaattatctgattggaattgacgtggggacatcggcgacaaagactgttctgtttgatgaaaagggttctgtggttgcttccgcgtccagggaatatcccctttaccagcccaggaacggctgggcggagcagaagccggaagactggaaggaggcggttcttgctaccctttcccaggtggtggcagagtcaggcgttttaaaagaggatgtgaagggaatcggaatctcaggccagatgcacgggcttgtaatgcttgatgaaaaaaatgaggtcatacgcccttccatcatctggtgtgaccagaggactggagccgaagtggaagacatgcttgagatcatgccaaaagagcgctggattgagatcacagccaatccgcctcttaccggctggacggcggccaagattttatgggtgagaaaaaatgagcctgagaattacggaaggtgcaggcatatcctccttccaaaggattacatccgtcacgtattgacgggagtttatgcaaccgaggtttccgacgccagcggaatgcagcttttggatgtgccgggaaggtgctggtcaaaagaagtcctggataagctggatattgatcaggagcttttgggcaaagtatttgaatcctgtgaggtgacggggacccttcttccggagatcgcggagaaaaccggactttctgtggaaacaaaagtcgtaggaggagccggagacaatgcggcagccgcggtagggacaggtgttgtaaaggatggaacggcctttaccaccataggtacttcaggagtcgtgtttgcccacagcggccaggtcaccattgatcccaagggaagagtccatacctgctgctgcgccgttccgggggcatggcatgtgatgggagtgacccagggggcaggtctttccctaaaatggtttaaggacaatttctgtcaggattatgtggaagaggcccaaagccaggggattgatgtttacgatctcattaacagggatgtggcccaggtagaggcaggaagcgataagctcatttaccttccctatttaatgggggagcggacccctcatctggacccggactgccgggcagtattttttggactttccgccatacatacaagaaagcatatgcttcgggctgtcatggaaggagtatcttattctctcagtgactgcaatgacattctcaaggaaatgggaatcagcgtgggagagatgatggcatgcggcggcggtggaaaaagtccggtgtggcgtcagatgctggctgatatgtatgactgccatgtaaaaaccgttgcccagacagaaggacctgccctgggagctgccattttggccggagtaggatgcgggatttatgagagcgtggaagcagcctgtgatgccctgatctctgaggataagtccacaggtccagaagaaagacaggccggcctttataaaaaataccatcagctatacaagcagctttatgaggatctgaaggacagctataaaaggctcgcagcgttataaatcgtacaaaaagaaaaacaggaggatgaatcaatgcgtttttttattgatacggcaaatgtggaagaaatcagaatggccaatgaaatgggaattatctgcggggttaccaccaacccgtccctgattgcaaaggaaggccgcgattttaagcaggtgatcggggaaatcgcctccattgttgacggtcctatcagcggagaggtgaaggccactacagtggatgcaaagggcatgataaaggaaggccgggagatagcggccatccatcccaacatggtggtgaaaattccaatgactgcagaggggctaaaggcagtgaaggtgctgagtgcagagggaatttctactaatgttaccctggtattttcagcggcccaggcccttttggcagcaagagcaggtgcagcctatgtatccccgtttttgggacgcttggatgacatctccatgcctgggatcgacctcattgaagacattatggaaatattccagattcatggaattgagaccgagatcattgcggccagtgtgcgcaatcccatccatgtgattgactgcgccaaagcaggggccgatattgcaacggtaccctacaaggtgctggttcagatgatacagcacccgctgacagaccagggaattgaaaaatttaaaaaggattatctggctgtattcggagaataaaaaaagagaggaaaaaccatgggattaccaatcaaaccagtgacagatccaagcttttgcacttacggaaaagtggtcacaggatacgatgcaggagagctgttggaaaaaatgaaggaaacacctcttccggaagatgtgatttatgtaccttccgtagaggaattagaagaactggcggtttctaaggaaatggaaaagaagctgtacggccagctgcccattcaggtaggctactgcaacggccacaataaaaagctgaacgcagtggaataccacaggaattcagagataaatatagccgtgacggatctggtcctgattttagggcggcagcaggatattgccccggattatacatatgattcaggcaaaatggaggcattcctggttccagcagggacaatcattgaagtttacgccacaactcttcattatgcgccctgccatgtagaggaagagggcttccgttgtgtggtgattcttccaaaggataccaacaccgatttagagcctgccggagaagccctgaatgaagaggacagattgctgtttgccaggaacaaatggctcattggacataaagagggcggacttccggagcatgcttatatcggcgtaacaggagaaaatctatctatttgacaaatgtttaacaatgaaatcagcaggcatatgactgaaaaggaaatgcctgaaaataacaggaggagtgatacaatgaataatatcccggaattaaaagtaggaatcgtggcggtgagcagggactgtttccctgaatccttgtctgtaaacaggagaaaagcgctggtagaggcatacagtgcaaagtatgatgccgcaaacatctatgaaagtcctgtctgtatcgtggaaagtgagatccacatggtccaggccttggaggatgtaagggaagccggctgcaatgccctggtagtatatcttggaaactttggaccggagatttcagaaacccttcttgcaaagcattttgacggaccggtcatgtttatcgctgcggctgaggaaagcggggataacttaactcagggacgtggagacgcctactgcggaatgttaaatgcaagctacaatttaaagctgagaaatgtcaaggcatacataccggaatatccggtgggaacggcagaggaatgtgccgacatgatcgaggaattccttcccatagccagaagcctggtagggctttcccagttaaaaatcatcagctttggtccgcgccctttaaatttccttgcatgcaatgctcctatcaagcagctttataacctgggagtggagatcgaagaaaactctgagctggatttatttgaagcttataataagcatgcagacgatccaaggattccggatgtggtaaaagatatggaaaaggaactgggagaaggaaatcaaaagccggagatccttccaaagcttgcccagtatgaactcacccttttggattgggtggaggctcacaagggataccggaaatatgtagccattgcaggtaaatgctggcccgcattccagacccagttcggatttgttccatgctacgtaaacagccgtctgacaggaatgggcatcccggtttcctgtgaagtagacatttacggagctctcagtgagttcatcggaacctgcatcagtctggatgccgtgaccctgcttgatattaacaatacggtgcctgccgatatgtatgaaggggatattaagggcaagcatgattatacccaccaggatacctttatgggcttccactgcggaaatacctgttccagaaagctttctgcctgttccatgaagtaccagatgatcatggccagagcgcttcctgaggaggttacccagggaacccttgaaggggatattgctcccggcgacattacgtttttccgtctgcagagcactgcggacaatttactccgtgcttacgttgcccagggagaggtgcttcccgttgcaacccgttcctttgggtccatcggtgtgtttgcaattccggaaatgggaaggttttaccgccatgtgctgatcgagaagaacttccctcaccacggtgcggttgctttcggccattatgggaaggccatatttgaggtatttaagtatcttggggtggaagaaatcggatttaaccagcctaaggggatgctttataagacggagaatccgtttggttaaaaaactctatattctttaaaagccatagctgtaaaaagaggaaggattctcccgcatgggggaatccttcctctttttttgtgcatttattgaagggagtttcggaaggccggcgcagcccactacgcagccttcatctggaacaaatttctcacaaagtgtaacgcacatcccggaacaagcagttttcagacatattctggaaaataaaaacaaaaagtcatcttgtagtaatcccggctgtacatctttttctgagactgtattcctgacgtcatttaaagcttaactattatcggaaacatcacatttagccaatatctgatgatttatttcttctatgagcaattcaataaaaaggtaaaaagtaggtgcatcatccaatactgattcgtcatacagccttgtgatacagggaagaataactttcatatccgtgtatcttgatataggtgaattttcagtcatggtaattaatatgatatttacccccttttacggaaggtgcaaacgctgtcatgatatatttttccgccgctgatggaaaaaataatgactgtatcctcttgtgtcaatatttctccaaaagcctcagtagtgcttaaatcattaatagcatgggcatcaatacggcatctgtttaaacgaaattccagctgttgtgcggaaaagaaagaatgataatgccctaatattataattttatttgatctgaggatgatttctgcaattagttttaactgagaagaattgtataatgtctctaattggctgaaacagttaagatattttctgaaagcagagagcgaatctccctcttcttgggtaaggtgtttttttgttactgcatgaggagtattcatgtatcggttcatttcgtatttaaattctgaaaagccagtatacccaagcttcttgcataaccttacaacattgctgcgggatgtattgcaatgttctgccagtgcttcggctgaataccgcacaacatccaccgggaattggattgcatattcagcaacaagtctttcaccgacagtaaagtttgacatattatcctttattttttctaatatattcatggttatatctccttcatctatatcatagcaaaaaaggtgtataaagtctattgaacaaatgaccaaaaatatattgaccaaaatgttcggaaggtgtatgataaagttaacagctgtattcccgggaaattaatacgataaaaagaaggagaagaaaaaatgagcaaaaattatgagaaaatgtcagaacaaattattgcctgctctgggggaggggataatttccttactgtaacaaattgtgcaacaagggtaagagttacatataagaatatggatgcagttaacattgaggatatgaaaaaaatcgaaggggttttatccgttatagttaatgatgcggtccaaatcgtcgtaggtccgggcgcctgtaataaaattgcggatatgatacagaaaaggctgaatgtagctgaagatccggaaatggctgacagttctgacgataaaaatgtttcaagtgtgaaaaagagaaaaattaatattttcagagttttttcagatatttttgtaccaatattaccggcaatgattgccggtggtgttttacaaggattaaataacgttctgaaaaattatgccgtagtgagagctgttgaagccggcatagaagcagtgggtgatttgacggcagctcaggtatggctgcagaattaccatttactgggtctgagtaatattattggagtgatttatacagccatatttggtttccttgcagtttatgtagggtatacctcggcaaaacagtttaagctcgaacctgtattgggggcggttttgggaagcattacgttacaaagtactctgaccggtgtaggtgcggtgcctggacaaggcggattgattggcgtaatccttggtgtttttgtaatgtcatatattcaaagagccgttaaaaaagcagtgccaaatgcagtggatgtaatcttcacaccggtacttactgttttaataacaactgcgcttatggttacaatatttatgcctgtatgcggtgtattatcatcgtctattgtacagggacttatgtggctgcttaataccacaggcccggtgggcggatttgtattatctgcattagctcctctgttaatatcaaccgggcttcatcagggattgacagccatacacatggaaatgattaacagtacgggatatgcaccgcttcttgcggttcaggttatgagtaatgcaggaatggtaggcgcatcatgtgccatctttattatgacaaaacaaaaagcggtaaaagatgcctgtaagggtgctattccaaccagttttctttgtgttggagaaccggttatctacggagtgtgcctgccgtctggatttggctttattaccggttctatcggtgcgggagtcggaggcttttttatcagaacatttgatgtggcatttaactccatgggcatggcagggatgtctgcaataccgcttgttgcagatggtaaatatctgtattacatgatcagttattttgcgggtgcggctgcagcgtttgcattgacattgattgttggtaaggcaaggcattaccaataaaaaatttatacaattatttttggggaattatccagaaagcaagaggttcagaaaaaatgagagcaattatggtaatgtttgatacccttagcaaaaggtttttatccacttatggatcggattggacaatcacacctaatttcaagcgtttagaagaaaaatgtgtggtatttgataatttctatggcggaagtatgccctgtatgccggcaaggagggaattgcatacaggaaggtataattttctgcacaggggctggggacctttagaaccttttgactgttcgattatggaagaattgaaacgtgcaggaatctatacccatctggtaacggatcattcccattattttgaagacggaggcgcaacctatcacaacaggtatgatacgtgggaaggttttcgggggcaggaaggagaccgttgggtgccgcagatttgttcaaacccggaattcaataaaaatcccctgaacaaacagggaatttcggctgtacagcactatgcaaaccgaagcaggattacctgtgaagaagagatgccaagtgtaaagaccataaatgcaggacttgagtttcttgatcgttataaaacagaagaaaattggtttttgcagattgagtgttttgatccccatgaacctttttatgtgccggaaaagtatcgcagcctgtatcagtgcggaaccttggaaaatgcatttaactggccgccttataaacttacaggtaatagtgagacgaaggataaattaggtgatctgaaaaaagaatatgctgcccttattaccatgtgtgatcatcacctgggacgtatcctggattttatggatgaaaatagaatgtgggaggatacgatgcttattgtaaatacagatcatgggtttctgttgggggaaagaggtttcatgggtaaaaattatatgcctatgtatgaggaaattattcacattcctttctatatgcatgatcccaggtatgaaaaagaaaagggcaggagaagtgaattagctcagaccattgatattgctccgacactgttggaatgttttaaggtagatttaaacggctatgaaatggatggcaagccgctgacgccaattgtaaatggtaataaaaaaatccatgaaaacatactttttggcatatacggtggtcatattaatatttacgatggaaaatacatgttaatgaaatcgccggaaaaggaaaataaacctttggtgagctggaccttaatgcctgcaaatatgagaggattttataaaagagagattctggaaggcggttctttcataagcggaggacgttttacaaacggaatcccctgcatgaaatacgaggaacaggtttatattgatccaatgcaatttggtgatttattatttgatttagaagcagatcctgaacagaagaatccgctggaagatttaaaaatcatggaggaaatgtgcagaaagctaaaaaaagcaatggatcaggtagaagctcctgaagaacaatttgtacggattggtctggagtataactagtgcggcacgccctggtcggtcaatagaagaatttcatggtacatcggctataacatcctatagaatgctgtagccgatgaaaatttattggattggagaaaagatgggactattaaataatcttattaaaaaaacgagggaaattccggcacaggaaataataactgcttatgcggaaggagaactgatatccattaaagatgtaaaggatccaacctttgcggaagaaatattaggaagaggtgttgcaattaaaccttctaagggggaattatatgcaccggtagacggtactgttgccatgttgtttgataccttgcatgccatagctctgacaactgaaatgggccaggaaattctgcttcatattggtattgatacagtggaattaaagggaaaatacttttctgcaaatgtaaaagtggggcagaaagtaaaagcaggagaattaatgatccgctttgaaattgaaaaaatacaggaatcaggatttgatacggtaattccaatgatcgtaactaatcaggatgaattcagcagctttcagttagcggatccccatactgtaaatattggcgagaaagttatggcagtatccaaataaaaagtgatatttaacctcggtgaagcggggcccgctgtgagcaagcagcgaagcggattgcaaatatccgattgatcatcatcaagtgacaaaggatcagaccgtcaggaaaatattataatattataaatcaaaaatgcggattccgtagaatccgcaaatatggcagctttagttatgcgcagtccaatcattagtctttgcttacataattcccttcataaccaggacagccataatacatgttattaagatgactgctgcagtaagggtaatttcaaaactgaaaatcctctttttgggagcgtcggcagaagctgttgaatcgggaatcataagattggatcttctcagggtggtcaccaaaggcttatagatgagaagagtcagggctgtattgattcctccctttaacaggttaaagggaataaatgccgggagaaggagtttgactacagcttcccgcggatatcccatgtaaatcggggtgatgaggtagttccacaaaaccatgaccagggtcatgagaagagtgcctaacaccatgccaaagaaagctccccacatggaatggcgcttcttatagagataagctgccggacaaacaaatgccactgttgatagaatgttcatgatcagcccgatgataccggtgctgctgatggtgaacatctctacaaaagacacaatgacagagatcagtgccgcggacattgggccgaataggaagcctccggtcaggatgataatatccttgggttcatactcaaggaaaggcagtattggaattaagggaatccggattgccacaactgctacaaaggccagcgcacaaagcatggccatgagggtgagtttgcttgttttctttgtcatattcatggttaaatcctcctgaaaataagtaacacctgaaagtatgcctttcaggtgttaaaaatagacaggtgtattatcactatttaacacatcttctttcatccagactatactgtcggtattggaatcacaccaattctgcgcaatttgcgctcgcggactttaccgccggtcgggaattacaccctgccctgaagacaactatattcaaatgttcttgaattattataacattttaaaaaataaatgcaatatgttgttgcaatttttttaatgctttgctataatagcggacatgggggtatagctcagctgggagagcgcttgaatggcattcaagaggtcatgggttcgaatcccactatctccacttaaacaataagccgcaggcatgaatgcttggggcttaaattataacttacagggacgggacacttgataaatcaagggcaaaaaaggtacattctcagttttgaaaatgtgccttttttgcctttttctatggatgatatgagaaggctcattgaaaaagttattgtacatgagaacagcactttcacggtggaattcaagagcagaactacagttgaaatataacacagaatagtatgggctttgtggctcctgctatttatttgcttttaaaaattttcaataacgattaaatgaaaaccagttgacgaagatgtgatggaagtatataataaggataacgaacaaatgttctggattctcaccttagtgcaaggggatgtgccttggtttaatataatactataaaataagttgatggatatggtaatattttactattttatctattaatttgaatatattatgatataattggtagtattaactgtggcagtttacagaacgggtgatactatgaaaaaagttgaaattatcaaagataatataaataccgaagctatctcaaatcttaagggaattgggttgcaaaagctacgtgcagttgaacgattattgtgtgcacttcaagaaaagcgaagtagcgtattttgtacaatagaatatgttgatgatgtttttgaatatgatatgagtaatggtacaaatgaaatcagatcggaacagaataagaattactcatctgatttttctattaatagtatagaaattaaaaactcaattagaatatttatcgatacatggcgtagaattgatgaagatgaaaatattatatttgtgttttattctaatgctggaaccaaaaaagagagaaaagtggggcaacttgctaagtttgatgagttaccagaaaaggggctcttagatttgctgaaagaacaacaatttgatgtagctctgtcatatgttattccagtcatcaaagaatattatgttgagcagcataagtcaaactcaaatagcaatgaaagcgagtcagaacgtaattattataaagtgtatattgatagtttgacctttgatcaatggaaagcttttttcaaactgattgaatggagatttgatgagaaaaatgaacgagaagttcgagaatgtattgataaaacagtcggggaattatgtattcaatataatgtggattcaaaatatcaaagtgcaataaccgctcgactttatgatttggtagaatcgcaagctatggaggatagtttcttaaaaaggatggtacatgttgctcagatagaacttttatttaaagattttgcacgcgaagctaaaatggatgaaagattagatcctcttcattataaatgggatgcattggaaaatttagatgcacgagatttgcaggaaaagattctaggagtttgtgctgattttgctgatatttccatggaagagatacaagacgattttgttgatggtaaatatgaacaggatcaatatgataatcccaaagcaataaaagcatataattatcgcatatatagtaaatgtaaaagggaaataaaaagatttctaattgagaaaaaacatattattatgactgaaaacattatattgtcttttttagataaaatgacagatgaagcatatgctgtagttttggataaaagtaaaacttatgatataccttatctagatagagatatggtatataaatctatattgattttatttcaagaatgctttattgcattagattgaggaagtatggataataaaaagagaatgatgtttgttctggatgaagattattattatgtaacattaaagattttgtcaacagtcttttttatttcgggattcaacaaaaagtttgttgattataagaagctttcttttattttggaattctgtaaaagtgattatcgcctaagactttatgaaaaggcagtcagtgatagaagtcttaatgtttttgagcatgaggaattaacaaccatttactgtaatgctaatttaaatgattctatgatacagagagtattatactttctggaaaagcaaggcataatacatatgagcaaaaatgatagatttggatgtatagatttggaattagtcaagagtaaagatttggaatctctttttgattcaaatattttggccagtgaacgaagtaatatcaacattattaaaaataatatgactcgcataggaacttacaaattcgattcttttatatctaaaatttatggtaaaaatgaggtggcaaaatgggaagaatagcaattagaagagtgagttatttcggaaaaaactattacttcgaatcgcctcatttaaatgatggcatagtattattagaaggggaaaatggtaacggaaaaagtacctttatggacttaatctattttggattaggcgggaaggttgaggggttttataaagatgatagaaaaatacatgataaacatactgaaatttattacgatacagaaaattatgtggaaatagaactggatattaatgaagagagatatgaattcacaagatatttcaacagaaatataatttatgttgttgattcggaggataatattgatgaatataatatttacagaactgctgataatggtaatgaagttttttccgattggttacttgaaaagttaggtattgaagtatttgatatgatacagggaacaaaacaattcaaaataggttttacggatttattgagattagtatactatgatcaaaaaactgaaatcggaaagatttataaggcttcagataatgataattttgtctcagattcaatagaaatccgtaaggcaatatttgaaatacttgttggaaagatttataatgagtattattctatgcttgctaaatacaaaactgaattaaccgagtttgaaaaacaacaagctgtatcggatagctatgatgattttctgcgtcaaattttagatggaaatatcgataattcggaatttattcaatctgagattgataagatagaggaattaactaagcaaaaatatcttgagagagatatagcaagaaataatgaagttaatagctttgaaatctttgatgagattaaagttcagcgaagtagagttcaaaagattcagctagaaaaagattctactgaaaaaataagcttagcaatcaaaaattctattgaaaaaatattatatttgcaggatgaagcaaaaagagagattgatgaagttgaaaaaatacgttttattgataagagaatgaaattattttccccaaacacatgtccatattgtttacatgatgttcaaagagagaatgggaagtgtatatgtggaagtgaaattgatgaagcacagtatgaaaagttcttttatacagatgcagaatatgttgaaatcattaatgctaagaaaaaatcacttaagtctttaaatgagttattagaaaagaaaagggctcgaaaactaaatgttgataatgatgtaaaggaatttgaaaatcaaataagagaaactcaagcttatattgttgatttagagaaagatattggcacaaactataactccgcttatgctaaacatttagatgaacaaattgctaatttatattctagaagtgtagatatgtccagggccaaggaactggcggctaagaaagaggctctggtatcatcatgtattaagcttcgtaatagtgtagattctttgaaaataaaagtcaatttacagttagataaagctaaagaggatatgcttggcaagaagaagaaattcaataaggtttacgccgagttaatgaaagcaacggacagctcttgttttgatgcgtatttaggtgaagactatatgccatatataaatggtggagcatacagggagcggagtgcgtatgtctcgagacgattgatgtacttttttacattattacttttaagtctcgaaaccgatatgaactaccctcagtttttgatgattgatacacccaataaggagggaattgatccggaaaagctaatcaaaattcttgtgcatcttgatatggcaaatgaaaaaagtaatctctatgataagaagtttcaaattattttgacaaccgggcgaggtgtttatccaaaggaatttgagaaatacgtctttttatctctggatgacgataataaactgcttaaaaggaggcaatgataaattcaaagggtctatatctactgacttatatatcttaaaattacaatgagcaatattacataatcatgagtaagtattttattaacttatgatttatctctggcaaatgtgagtggacagagattgctggatttttaactgccgccagggtccaaccacaccctgacggtatcatttttatctcttcaaggcatgttgagaagtttgtcaaataatctcaccaaaaaattgagatggcaatgtaacctgacggagaaagtaattatacgccgcagggaaatactacttgatattgtcaagattttttcgcaaattatatttcaaccgttgatgacgtataattaatttcgcaaatttaatttcataaaaatagacatggtctatagccgtttggtagaattaagttaccacacaaaatactctcaaaggaggctatagaacatgtctgataatattatacaattaaaccaggaacttatccataacgaattgaaagatttagtacgcaacagcgttgaggaaaccctcaatgccttgctggatcatgaagcagaagaactcgttaatgcggaaaaatacgaacgttccggtgaacgcaagggatatcgttccggccattacagcaggaactttcaaaccacagctggtgaggtcaaattaaagatgccaaagctaaagggtgttccgttcgaaactgccattattgaacgctatcgccgcagagaatgctccgtagaagaggctctcattgaaatgtatctcgcgggtgtttctgttcgccgtgttgaagatatcaccgaggcattatggggaactaaagtttcacctggaacaataagtaatctaaataaaaaaccttatgaacacattgaaacgtggagaagccgcaaacttagcggttcttatccatatgtttatgtagacggtgtttatttaaagcgcagctggggtggtgaagttcaaaatgtctctatccttgttgctattggtgtcaatgaagatggatgccgtgaaatcattggcacagcagaaggtatgaaagaagatcgtgaaagctggaggacattctttgtatggttaaaagaacgtggcctggctggagtgcgcctaattattggtgataaatgccttgggatgctcgaatccattccagaagtatttccggatgcaaagtatcaaagatgtacggttcacttctatcggaatatattttctgccactcctcgtaataagatgaaagaagtctctatgctgctaaaggctattcatgctcaagagtgtaaggtatctgcaaaggaaaaggcaaaacaagtagctgataaacttcgcaagatgaaattaacttcggctgccaaaaaggtcgaagatggaatcgaggaaactcttacatacatggattttcccagccagcactggactagaattcgcaccaacaacaccattgaaagacttaatagagaaatcaaacgtagaactcgggcaattggtgcttttcctgatgggcaaagtgctttaatgcttgtatgtgccagactgcgacacgtagcaggaacccaatggggaacaaagcgctacatgaatatggagcatctgaaagaattggatctccagaaccagtctgatatcatagccggttgactaccggctactggacggttgaaatacaatttgcgaaaaaatcttgacactttcttaaaattttatcaattaaccgttttgtcttttttgcgttaggcaaaataaagtcaaaccgttctgaaaatgttttatgacagcattgtagattatcacaaaacatttttcttacactaagcagaagaattgtttgtttatcctgtaaggaaatatcttgaatttctcgctgataaatagaatgaattttaaatgatgaatttccgcaatatggacaattcactgcttttttcatagaatgaacctccataattattttatcactttttattctacaatctgaacattctaaattcgtatccaattctttgataagttcttgttccatatataccaccatcctatatgggcattctattactttatcacattaatatcaactaatattggaaagaacctattgagctcttacttttcaagttaaattattcccatcatgtaatgaaatatatttttacagtgggaatggtgaatttttccatacgacaccgtttgagtttttttcgaatagatgtctttttgtttgccagtcttttggacaagcctttgtgcagcttcgggccaagttggcctggtatgcggtacagacagattgcggacattgggcgtgaaagacggaagtacaagtggttcggttaagtccattcattcaaaaaacttgtctgagagatttgaaataacctgtacatacaacttttaaagaaaatggaaaaaaaggtaaaatacgtattgacaaaatatgaacaagaatatatagttattttatggttattaaatattactataaaatgcactggtgtatatgaataaattgagcaaaataacatgaaagttaattcggagtatgataaaatacataatagtgaataaaaatgcaaaattgcgcaaagcgcaagttgtatatataaaataataccacaggagggtaaaaattatgaaacgaagaattctaagcctcattctcgggacagtcctttccgctgccatgctggcaggttgcggcggttcccagacctcggcaaccacggccgcgccggcggctgaaaccaaagcagaggccaccacagcagccaaagaggcggaaacccaggcggcgaaagccacgggaagcggcggaagggtcggcgtggctatgcctacccagtcctcggagcgttggatcaatgatggagccaacatgaagaagcagctggaagccctgggctacgaagtggatcttcaatacgcagaggacgacgttcagatgcaggtttcccagatcgaaaacatgatcgcttccggtgttaactgtctggttattgcttccattgattcctccgcattggtaaatgtggaagagcaggcaaagagcgcaggtattcccatcattgcctatgaccgcttgttaatggatacggatgctgtatcctattatgcgacctttgataataagggagtaggtacagctatcggacagtacataaaagacaaaaaggaactggataaggccaaggcagaggggaaatcctacaccattgaatttttcatgggatctccggatgacaacaacgcattgttcttatacaacggcctgatggaggttttaaagccatacctggatgatggaaccctggtatgtgagtctggccgtacttcctttgaggatacttgtattttaagatggtcccaggaaacagcacagcagaactgcgagaattatctgaccggcttttacgcagacaagaagctggatatctgtgcttctgcctttgacggctttgcctatggctgcaaagcggctcttgaaggcgcaggctacaaagtaggcgaggactggccgcttattacgggacaggatgcggagctgatggctacgaaaaatattatctcaggcttccagaccatgtccatttacaaggacacccgtctgctggctgaaaagtgcgtgaccatggttcaggctgttcttcagggagctgagccggagatcaacgataccacccagtacaataacggcaagatcgtagttccgtcctatttatgcactccggttgcggttgataaggacaattacaagaaagtcattgttgacggcggttattatacggaagcacagctggcacagtagcaaaaagaataacggaataggaatattgacaggcggcggcgaagaaaccgccgcctgcttccgtgtaacgtaagaaagtaaaggagttgatgagatgtctgaacatatcttggagatgaaccatatcaccaaagagttctacggggtaaaagctttggatgatgtaaatattaaggtgaagcggggcgagatccatgcactctgcggagagaatggagcggggaaatctactttgatgaacgtgctttccggcgtttatccttatgggacctacagcggcgatattgtatacaatggaaatgtaagtcagtttcacagcattaagcaaagcgaagcaaagggaatcgtaatcattcaccaggagttagccttaagtccctacttgtccgtggcggaaaacgtatttctgggaaatgaacagacagcggttaaaggggtggtagattggacgaaaacgaataaacgggctcaggaaatgcttgagaaagtaggacttgaaaatgaaaatttaaatgtacctgtcagcagcctgggcgtaggcaagcagcagctcattgaaattgcccgcgctatggcaaagcaggtggagcttttgattttggatgagcccaccgcagccctcaatgacgaggagagcaggcggcttctggacatcatgctggatttgaagaagcacggcattacctgcatcataatttcccataaactcaatgaaatcagctatgtggcggattccattaccgtgatccgggatggaaagaccatagaaaccctggaaaaggggaaggatgagatcagcgaggaccgtatcatcaagggtatggtggggcgggagctgacgaaccgttttccggaaagatgctgtgatatgggagataaaatttttgaggttgagaactggaatgtatatcatcccgatgatccggaccggaagatggtaagggatatatcctttcatgtgagatcaggggaggtggtaggctttgcgggactaatgggcgcgggaagaacggaactggccatgagccttttcggaagatcctatgggcagaaaattactggaaccataaagataaacggaaagcaggtcctcatccggaatgtaagagatgccatcaataacaaattggcctacgtttccgaggaccggaagaattatggtcttatcctgattgacagcgtgcgcggaaatatgaccctggcagcactgcgcaacttcttttccaaaagaggtatcgtaaacggcaatgccgaaaatctttcatcggaggagtatagaaagaaaatcaacgtaaaagccaattccattaaccagacagtcagttccctttccggtgggaaccagcagaaggtggtgctggcaaaatggatgatgacccagccggacgtgctgattctggatgaaccgacccggggcatcgacatcggggcaaagtacgagatatactgcgtaatcaacgatttggcaaaggcgggtaaggcaattattgtgatctcctcggagcttcaggaaatcattggaatctgtgaccgcatctacgtcattaatgagggacacataaccggtgaattatccagtgacgaagtttcccaggaaaagattatgaaatgtattatggcagataacggaaaggatgaatagagatggacaagaaaaagacggttaatattaatatgaaagaatacggcatggtactggctcttattgcggtatttctcatttttgcggtaatgacaggcggaaaaaacatgtccccggcaaacattaataacctgattatgcagaacagctatatcgtcatccttgcggtcggcatgctgctgtgcgtattgaccggaaatattgacttaggtgtaggttctatcgttgcggtctgcggagcggctgtaggcattatgatcgtggactataaggccagcatgtggatggcgattctggcagccctggcaatcggcacattatccggtatgtttgtaggattttttgtgtcaaagctttccattcctccctttattgtgacgctggcgaccatgttaatgggccgggggcttacctataccctattaaaggcccagacaaaggggcctcttcccacaaactatacatacattggcgcaggctttctgcctaccgttaaaattccgtttgctacggggactttggatatggtatccattggagttgcccttaccgcctttgcactcattattttcgccgaaataaggagcatacggacaaagaagaaatatggttttcctgtcaatcctctgtggcagtctgtattaaaggtgggtgtgattctggtgattgtctggtttttcttctacaagctgtcccgttataatggtattccgtttgttctggtgatcatgggcgcgttggttgtcctctatcatttcattacaagcaggactgtggctgggcggcagatttacgctttaggcggcaatgcgaaagcggcaaagctttccggcatcaatacgggaaaggtctttttctgggtatataccaatatgggcatcctgtgcgccattgccggtatcgttctctctgccagaaacgcttccgcaactcccaaggcgggagaccagtttgaaatggatgccatcgcttcctgctatatcggaggagctgcgacaaccggaggcgtgggcacgattatcggagctgttgtcggcgcatttatcatgggtattttgaacaatggtatgtccctttacggctggtccaccgacatccagaaaatcgtaaaaggtgctgtacttttgggggcagttacgatagacttattatcaaagagaaaaaaatagctgaaagatagggatggaagatgcaggcacggaaagcaaaatatatggcggttgtccaatgggtacaggaacagattgaaaacggcagcatcgggaggggcgataagctcccctctgaaaacgagatgagccttcagtttcatttaagcaggcagacgatacgccatgcaatcgacgttctggagcagaggaagctggtgacgcggatacagggaagcggaacttatgcaggcggctgtgcccggggaggaagtcaggaaaaatattttaatatagctgtcatcagcacctatgtagacagctatatatttccggcagtgcttaaggggattgaacgtgtgctttccaagtctggttataccatgcaggtggcatttaccggaaaccggactgaacgggaacgagaggcgctggataaaattctggaaaaaggactgatcgatggtttgattgtggaacctgcaaaaagcgccctgcccaaccctaatttgcactattataagaagctgatgggacagcaggttccggttttattttttaacagccgttatccggagttaaatcttccctgcgtatcacttaatgacgcgcttgtaggggagaaagcggcagaatatctgattagagctgggcacaaggagataggggggatttttaaatgtgatgacggtcagggccatttaagatattctggttttgcaaaaagtatggagagggcaggctttaagctggacggaaagagaattctgtggatcgattccgagagcctgaaagatatggagttatgggcggaatatctgttccagcggctggagggctgcacaggggtggtctgctataatgatgaagtggcaaacctgttgtctggaatctgcttaaaaagaggaatccgcataccggaggacttatcccttgtcagcattgacaattctgatctggcaactttgggagaggttcccgtcacctcctttccccatccaatggaggccctgggaagaaaggcggcggaacatatgataaagctgatagagaatccgtgttttgatgggaattacctctttgattcggaagctgttgaaagggagtctgtgaaatttatatcaaaggagaatgctaatgagtgagaagaaaggttcctctaatccacctcagagtaccctgatcctgcggcttgtgggcggtggctatctggtttatcttgggtaccaaatgataacggagctttcaatgtcttccggggtccgaaatctggttcaagtgtcagctatggtcatattccttgtggttggtatattgcttgtgggatggtctgtgaaaaagctgcttcggagggaatatgtgcgtccgggggaggaagaagcggacaggatagaaggagacaataaggaaaattgatttgttttttatgaaatagggagttgtcaatatggacggctcctttctttacggactttaacctgttgagcatggctgggaaatctggcataaagtatccttgactatttttatttaaacagataaaatctgaaatgaaaatgtttaggaggactgtggtttggtacgaacaagagtaggagagaaatcgaatcactcagcgggaaattaataacagcttagcaggattattacaaattattcggatgcaaacagtaacaaaaataatcggaaggagttataaccatatggcaacaatactgattgttgaagatgatagacatacacggttgcttacctgtgcaagactgaaaccatattatacagtggcagaagctgaaaatggagaaaaggcgcttgaaatactggagcaaaaacatgttgatctcattattgcagatatacagatgcctgttatgaatggttatgatatggtaaagggattgcgggaatcaggaatacagataccggttattatgctgaccgcaatgcatacgtttgatgataagaagacaggctttgcttcgggtacggatgattatatgacaaagcctattaattatgaggagcttctctggcgaataaaagctttgcttagaagagccaatatagccagtgaaagaaaaataattatcggagatattactctggattcgactacctatacagtagcaagaaaggcaggagaaaagacagagcttgcaaaaaaggagtttgaacttctttataaacttctttcctatcctggtatgatttttacaaaaactcagcttcttgatgaaatatggggatatgataccaacagcgatgagacaacgataaagacccatataaacagactgagaaataaatttgcagactgtccggagtttgaaatcattacaatcagggggcttgggtataaatccgagctttgtgaaaaatagacctttttaataaaaacagaagcttcattagaaatgggatgcacatgaaattaaaaattaaatttgaaaaaagagaaacacttactttacattgggctgtatggttttatattttaatactcatcagttctgttatggcttttggacttattacttttctgaaatttgatatgagagaaaataatgcaatttatatgctggctatgattccgtgtatgggcctggtggcaggggcagcgattatcagaatcataaaaactctgaaatttcggatggataaaatttcgaatggaatcaactacgtggccgaaggaaatctggatattgaactggatttgaacggttcgggggaatataaagatatgtatcggaattttaaccgtatggtccgggaacttaagaatacgaaaatagaaatgcagaatttcatgaatgatttttctcatgaatttaaaactcccataacatccattcatggattcgcagaactgctgctggaggactatatcagcgatgaggatagaaaacaatatctacagatcatagcggaggaatcccatcgattggcgtcgctttcccaaaacactcttttgctttcaaagctggatgcgcaggaggttataacggataagaaagtattcgatttggatgaacagattaaaaaatgcgcgattttattgttccgggaaatggagaaaaaagagattgccttaaatatggaattgtctccggtaaagtatttcggcagcgcggaactgatgcatcagatctggatgaatcttatcagcaatgcggttaaattcacgccccatggcggagaaattaccataataatggtttctgtcggagatcagataacggttaatatatcggatacgggaattggaatggatgaaagaaccgtaaagcatatatttgacaaatactatcagggagattcctcccattccaccatggggtttggacttggtctgtcaatagtgaaacgaattattgatttgtgcggaggtgagataacagcaaccagcgctccgggacagggaagtacattttcagtattgttgaaagctccagtacaaagaattagaaataaataagagaaaaaaaggctgtatatggcttgaacttttttctcctgtctgattgacagggaacagttctaaccgtatacagcccttttttaaaacttttatgctgtacatgtaagtttacgttgagtttacaaaagctttttacaatgaacaagtaatcagtatttcattctcaggaggagatggcgatgaaagcattcaataagaatattgtagtaacgggtggcggaaacggtgtaggaaggcaattggtacttgaactgctttccaaaggagctacggtaattgctgttgataaaaaccagatggcactaaatgaaacgattgaaatttctggaaataacagcaggttatacacacatgctgttgatatttcaaatataagagacgtagttgcatttacagatgaggcagtatcaaagtataaaaatatagatggacttataaactgtgccggtatcatacaaccttttttaaaactggaagaattggaactggatcacattgatcgtgtaatgaatgtgaatttttacggaacgctttatatgacaaagtcatttctgccatttttaaaagaacgtccggaatcccatttgatcaatatatccagtatgggcggtttcctgcccgttcctggacagggaatttatggtgcttcaaaagcagctgtaaaagttatgacagaagcactccattcagaacttgcgaatacaactgtgaacgttacagtcgtatttccgggtggtgttgccacggatatcaaaataaattcagaaataaaaggaagtaaatcagtggcagaagatgcaagagccaagaacctgctgtctcctgagcaggctgcaaagctgattgtagcagcgatggaaaataaccgttttcgggtatttataggaaaggattgcagaataatgaacgccttatatcgcttgtggcctgaatatgcgatgaaattaataagaaaagtactggcagccaataagcattaattttttcatattaatgaagcgttggatcattagaaaggggaacggaatgatgcgcaggatttgtgtaattacagggggtggcagcggcatggggctggctgctgccaaagaaatgggaaaaaattattatattatcatatgtggaagaaatccgcagaagctggaagaagcggtaaatgaattgaaagcggagggaatccaggctgaagcatacccctgcgatgtctctgattataccagtacggagaagttggctttttattcgaaagcgaaagggtcagtggcagccgtaatacatgcagccggaatgtctccccatatgggagatgcaaaaacgattattgaagtgaatgcgcttggtaccatttatattaataatgctttttacaaagtgatggaagaaggctcctgtttgattgatgtgtcttccatgtccgcttatttaactcctaaattagtaatgcctgtcagattatataagtacagccgggaagatccggaacatttcatgaaaaaggtaatgaaacgtattaatctttatccggaaaaatatcgttccggtatcgcatatggaatttcaaaaaattttgtcatctggtttgcaaaacacgatgcagccagatttggcagtaagggggccagagtactttccatatcaccaggcaatttcgatacacctatgggtgaactggagaaagaagaagcagcatctttcataaaattctgtgcggtaaaaagacctgggagggtggaagaaatagccagtctcttctcatattgtgccagtgaaggcgcaggatatttaaccggagtagatattttgtgtgacggcggattggttgcatccggagtaaatgcaatgctgaaaaaggttgtttaaatgtacgcggtctccttgccgatgaatcaggatcaaataataatgatttttataaggagcagaaaatgaaaaagaaagttttattacttggaataatcgcagttatactgattgtgccggtcattattcgggttaatgaaaaaaaggttacagagaagattgatgtgctgccggttgtggaaacagtatatcctgaggttggcacaattgagttgtataccagcctgatcggaaccgtggaaccagagacggtagtcaggatttttccggaagcagcgggaaccattacacaagttcccgtaaaagccggtgatacggtaaatcagggacagcttctctgtgtgattgacacaaataaagtacagaacgcaaagaataccatggataatgctgaagttacatataaagaagctcatgatactttgggacgcatggctgtactttatcagagcggatctatctcagagcaggaatatcaggggtatacaaattcggcaaaaaagtcagagattgcttttagacaggcgaaggaggaatatgaaaatcagatttcctacagcaatatcaagtccccgatcagcggcaaaattgagagctgcagcatagagggatttgacaaggtgtcagtgagtgatcagatctttgttatttccggagagggaaataaaattatttcttcaagcctgacagagaaattaaaacgccaggtacagcttggagacacggtaaaagtgaaagaaggcggagaagatctggagggaaccatttctgaaataagtgggatggcagatgaaaagacaggactctttaagattaaaatccagatgatcggagaaaacgatttatcctccgggacgagtgtcaagctgtcggtatgttccaatcgcgcggagcaggtgcttacggttcctgtggattccgtctactatgagaacagcaaaccatatgtctttacttatgataatgggattgtacataaaatttttatagaagccggtatttatgatctgaatctgttggaggtgaaggaaggaattcagaaggatatggcagtcattactacctggagcccggagctttacgagggggcagaagtgttggagatgagcaggagtgaagaaacaaaaggagaacctaaggcatgaataatttaacaaaaattgttttgaaacggcctgttaccatcatcatgtgtcttctgtgcctggtagtatttggtatctcttctgttaaggattccagacaggagctgactcctgagatgagcatgcccatgcttatggtcgtgacggcgtatcctggagctcagccaaaggatatagatgaattaattggtaaagaaattgagagtgcagttggttcactaagcggtattaaaaaggtgacatcaaaatcttcggaaaatcgctccaccgtcacgttacaatatgaatacggaacagatcttgataaggcctacgatgatctaaaaaagaaaatagacggaatttcctcaaatttgccggaggattctgaagtaccggtggtgatggaattgaatatggcctccactgctgatattgctctggttgtcagtggaggagaaactgaaaatcaatatgattatgtaaaacaagacatcgtgccggaatttgaaaagctgtccaatgcagcagaggtatcaattgcgggcggaagtgaggattatatcaaggtagaactgaacatggaaaagatgcagcagtataaactttccatgtcttctgtagcaaatgatatttctgcatctgatgtaaagatgccagggggagcaatagaggtaggcagaaaaaaagcagcaatatcctcgcggctgaagtttgatacagaggattccctgcagaatataccgcttacagcacccggtaataatattgtttatctgggggatattgcatctatttatacaacaagtgaaaaagagggaagtattgcccgctataacggaaacaatacggtttctctttctataagcaaacagcaaagctccactgctgcagaactttcgaaagaagtgaaaagtgcaatgaaagcgctggaatcggtgaatccggaattagatatacaaatgattcatgacagctcagaggatatcatggcctccttgttttccatagcagaaacggttgttcttggtatcattatttccatgatagttatctggctcttctttggagatctgaaagcttccctaattgtcggaagctctataccggtttccattctggcggcacttattctgatgaaattcatggactattccctgaatatgctgacccttgcagcattatccatgggagtggggatgatggtggataattccattgtggtgatggaaagctgcttccgggtgacggcacaggaaaagaaagaattcatcgattactttaaggatgcattgaagggttcggagattgtggcatcttcggttttcggttctaccctgaccacctgtgtggtatttctcccgcttgctttcttaagcggtatggcaggacagatgtttaagcctctgggatttactatcgtattttgtatgggagcttccctgatatcggcaataacgatcgtaccattatgttatttaatatataagccggaggaagccctggctcctttgtccgcgcctatacaaaaacttcaggatgcttacagaacaattatgcgctatattctgcctaaaaagaaaacagtcatgtcagtatctgttcttctgcttttagtatccttccttatggccgcgcagctcaaagttagtttgatcactgcggatgaccagggacagcttgccattacggtgaatatggttccggggcttaagacaaatgaagtggatgaactgctggaaaaagtagaagctgcattctccgattacggggaaatggattcttatataaccagttatggaggaagcggagtcagtgcaggaagttctgcaacgatacttgtatatttaaaagacaacaggaagataccgacagatcaggcggtggatatttttaaagagaagttaagccatgtatcagattgcagcattacagtaggagaaaattcttatgcaaacatgaacagttctggagatacttacgaactgatcatgaaaagtgcaaattatgatcagttaaaaaggacctctgaagaacttgtatcaaaattaatggataggccggagcttaccaggatacattcttcgatagagaactctgcgcctgttgtggaagtaactgtggatccggtaaaggcaaaagcaaaaggcataagcccatcttctatcgggcacagcatttatcaggcgattaatggggtgaatgcgaaatcaatagaagtagatggtgatgatgtggatgtaaaagtccaatatgcggaagacgaattcaagacaatggatcagatccggaatatgaccctgtccctttcaaatggcggttttacagctttagatgatgtagcggaattaagctttcaggacagcccggcaagtattacgagagaagataagcaatatgtcgtaacgattaccggagattatacatcagcagcagataagaaaacgaaaggtaccattaacagtgaagttgtagtgccgaatatgaatcctcttgtgagcctgggggtcagttcagtagatgaaacgacggcagaggaacttaccactcttcttaccgcaattattctggcagtttttctggtatttgtagtaatggctgctcagtttgaatcaccaaggttttcctttatggtcatgactactattccattcagccttattggtgcttttggcttgttgttcttcgcaggctgcgaattgagcatggttgtaatgctcggatttttgatgcttgttggaacggttgtaaacagtgggattctttacgtggatacggtcaatcagtacaaagaggagatgtctcttgaagaagcaatgattgaagcaggagctactaggctgcgtccaatcctcatgacaactctcacaacggtgctgtctatgattccaatggcacttgcattgggccactcaggagaaatgatgcagggtcttgctattgtcaatataggaggtcttaccgcttccacagttttaagtctccttatgcttcctgtatattacaatattatgtgcagaaaggggaagaaagagagaaagaaacgaaagaatctggtgactgaataggtttgaaacaagatgaccttgttataagggatcagtatgctcagtattaccgggatgcggcaagtgatgccagaagttccatatcgggagatgatacagtttcagatgctaaaagtgcggtgcgcaccgcgaaaacagataaagaggcggatgctgaatatattgttaattggattgtgaagagattggttcagtaggcggtggcataggtactcacgtctttatacgatgaacaattttacaatcatagttaagataatggccgttcgaaataccaaacatataaatagatctagagtatgcaactatttaaatatactattaaacatccgccacgcagaggaggaatgacgcaatgatattatcttttcgctttaaaaattttcgttcctttttgtacgaagtttttattgatatgagtgcattaaattatgaggaacacccgagccatctgatccaggctgacagcaaaaggctgataaagactctggctgtttatggggccggctcaagtggtaaaactaatttatttcttgcacttgtgagttttcactctcttatttacagacagctttttttactgaagggtatttcagaaaaatattacatatcgcttttggacttaaactgcaaaagtaagattgttccttatcaaataacagatatgaatcatcagcctacggaaatggaaatttcttttgtaagtggccagcgtgtttatgaatatggcttcactattaaaaatcagaatattcttgcagagcatctgactgtagatcatcatgtggtatatacaagggctgcaggagtaatatccgtcggacgcaggtttgaaaaactttttgataaacagactgctttccgtccaaatgataaacgattattttgttctgttctatcatgtttggacattccggaaattacagatataatggaaccgtttgaatgttttttttatgaacatattgtgtattgttttgattttcttgaaccattccaattacttagtaatgcagctatagaagagaaaatttataaaatactggaaaatcatgatgcacttgattttggtttggagcagcttcaaaagctgggaattcctgtggaagaccttattgttgaacaaggtattcccatgcttggatatcgcgtgaaatctcggaccaccgggcaatacaagacacaatatatgaactttacaaatgtttccgacagcacaatgaaatgtctgttcttatttataaaaatatacaatctatgccaaaaagggggaatcttaatcattgacaatatttctgacgaatttcaaccgactgttgcgaaatttataatagatttttttcaacgggatagtaatgagaatgttcagcttattttcacaattaatgattactctgttttaaataatcagcaatttcggagagatgaggtggcttttgtggaaatcaatgaataccacgaatcaaggctatacactctggcagacatgatggtacgagctggttcaaatttatcattgaactttttggaaagatatagaactattcctatttttaaggattatatcttataatttctgtgttaattgtcagctagggcgaattgccatgatgtactttggtgttgttaagatttcgtttgaagggaaatattaaaaatatgaagaggctctaggcatgaatgcttgtggcttaaattgaaaatcgacatcaggataaatacaaaaggtacggttgatataactgcaattcccagacgccagtctaaaagcgttacaatcacaaaaacagccacacagaccatatacgtaataaccacgtcgggaagggtttttgtgtgcagtcagaaaatcgggataagtcatctcaaaaatattaaatgttaataaacaaatctgaaaaagtgttgttttgatctcaactaatcacactctgaatcatgttattccatgaacaagaaataattttaaatacaatttagatggcatttcataattcttaaataatctgaaatcgttacaatatctattgtcatttttttcagaagaaactataattttgcagtggagttagattaagctaactacttataatcatagaaagggagatatgcttcttatgaaaagacaatggaataaaacaagacttgcagcaggagtgatgagtatcgtactgcttatggccggttgttcgtcccaagtaccttcaaatgaatcgtcatcgtcttcttccgattcgagtacggtaaaaaacgtagccgcaaaggatgaagtaattgttgcagttggcggagaaaaggaatcgggatacgatccctgcaagggctggggaagccacggtacgccactatttcaaagtaaattactggatactgatatcaataaccagctgaaaagtgacttggcaacagattacaaagtcagtgaggatgggttgacctggacatttaccatccgtgatgatgtactttttcatgatggagtaaagctgactgcaaaggatgtcgcatttacatacaataagacaaaggaaattggtatttctaccgttgacctgactctgttggacatggctgaagcagttgatgatacaaccgttgtatttcacatgaaatcccccatgtcaatttttgtttatcagacagctgcactaggaattgtaccggaacacgcttacagcgacacttatgcacaggcacctatcggttccggcccttacaagtttgtacagtgggataaaggtcagcagcttattgcagaagcaaatgaagaatattatgacggaaagccgccattcaaacgccttgtgcttctgtttcttagtgacgacgcagcgtatgcagcattacaggcgggccaggtagacgtagcaaaaatttcagaaaatctggccgttaaaggaatgccaggttacaatctggtagactgcaaaaccaatgatttccgcagcgtagcacttcccgttcaaaaaccgggtgaaaccagtagtgaaggatatcccattggaaacgaagtcaccagtgatttggcaatacgaaaggccctggcaaacggtatcaatcgtcaaaaaattattgatacggtacttaacggctatggggatgttgctttcaccatttcgcagggtctgccgtgggacaataaggatattattttaactgacggcaatgtagatgcagctaagcaaattttagaagaagccggatgggcagacacagacggagatggaattcgtgaaaaggatgggcaaaaagcagaattcagtttaatctatgcttctgatgactcgactcgccagtccatttccatggcctttagtgagcaggcaaaagcgtttggtatcaatgtaataactgagggactatcttccgcagaccgtacaccgagaaagcacaaggatgcgttcatgctgggcggcggcgattacaatccaacacctgttatcaatgcactttacggtccttatgcagcaaaaggcggatggtataatatagtagcatataaaaatgcaactgtagacaaatatctggatgcagctgtagcatctaccactcaagaagaagccaatcaatattggcagaaagcccagtgggatggaaccacaggaggaagtattcttggtgatgcaccctacatttacatcgtaaatatcagccatctgtattttgtacgagatggtatcagcattggagaacaaaagatccatcctcatgaccatgggtttgcggtgctgggcaatattatgaattggagttctgtaaaatagtctgcaatttaatatcaaggaacgcggccatgccaattaagcggcttggccgctttttacaggaagaaaggagaggtgtcgaaccaaatgaataagagcctaattcaaataattgcacgaagccttttacgtgggataaccttattgattgcagtggttattattacctttttgttggcgaacgcatccccaattgaccccataagcgcttatgtcggctccgagagtgcgatcagtgaggagcagagagaggcaattgcccagtattgggggttggatgagccgcccgccggccgactgatcaattggataaaagccgtatcaaaaggagacatgggcaagtcctattattttcagcagccggtaacagcagtaatcggggagcggtttacacaatccattatgctgatgggcgttgcatggatcttgtccggagtttttggatttctgttgggtgttattgctgcggcctatcgtcacagtatagttgacaaaggtatcaaagctgtgtgcctgctgctgtcatccagtccggcattttggttgggactgctgttaatgatggtgtttggggtaaatcttgggtggtttccgctggggctggcgacacctatcggcaagctggctggagaggttaccatttgggaaagactgcaccatctggtgctgcctgccgttacattatccattacgggtgtttccagtatcgcgttacatacccggcagaagctcatagacattctggaaagtgactttatgctttttgcacaagcacgaggagaaggaaagtggcaggcaatacgccgccatggatttcgcaatatccttttaccggcagtaactttgcagtttgcagcaatcagtgaattatttggaggatcagtgttggcagagaatgtcttctcctatacagggatcggacaggcggctgtattggcaggaacgcatggtgatacaccgctgctaatgggagttgcattatttagcgctttgtttgtattttgtggtaatatgatcgcaaatctgctttatcccattattgatcctcagatcagggaggccgcacatgacaaataaagcaatagctacagaaaaaaagctttttatcaatcgacgcacatggacattaatcactatcatagctgccattgtcatcctgcttggtgttgcgattgcagggattttaatgccttcggatgcctatgccaccaattttgaaaataagaatcaagccccgtcgttttcacatctctttggaaccgattggatgggaagggatatgcttgcccgtaccataaaggggctttcgaccagtattctgattggtatgttagccgcaggtatcagttctatgatagcggttattctggggacactttccgctgtcatgggcaagaaagtggatcagttgattttatggctgattgatatggtgcaggggatcccccacctgattttgctgatgctgatttcatttatgctgggcaaaggtttgcggggtgttatggtaggaattgcaatcagtcactggccgaatctggctcgaattgttcgcgcagaggtcatgtcggtaaagaatggccaatttgttcatgcatcccgtaagatgggacacagccgtatgtttattgccgtacggcatatccttcctcatgtaattccgcagttcattgttggtttaattctgttattcccgcatgcaattttacatgaagcatccatcacctttcttgggtttggactatcaccggaagaaccggcggtgggtgtcatcttatcggagtccatgcgctatttgacctcaggcttttggtggctgaccgtgctgcccggtgcggctcttctgattattgtactgctttttgatgccattggagacaatcttcgaatgattatagatccatacagcgcacaggaataggagagtatatgttgcagaaaaaagaaaaacctcctgtattagaggttaatgatttatcgatttgttttcggatgtatgaccgggggctgaaccaaaaggaattaaaggtgatttcgaaccttgacatagctataaacgcaggtgaaatattagcagtagtgggttcttccgggagcggaaaaagtcttcttgctcatgctattttaggaatattgccaagcaacagctcttgggcgggttccatgaggtattgcggaagagagcttacgccccggcttcaaagaaagctgaggggaaaggaaatcgccctggtccctcagtctgtgggctacttagatcctatgatgcatgttggcaaacaggtcagcggcattcatgggtcagaaaaacagcagcaagatgttttccgtcgttttggtcttgtaccggaaacagcacagaaatatccatttcagctttccggaggaatggctcggcgagtcttggtgtctacagcggtcattacagatgcacatctcatcatagctgatgagcctaccccgggacttaatgcggaggtggcggaggaaaccatgcgctatttccgtgaaattgccgatcagggaaatgccgtcatgctgattacccatgacattgatttggcgctcagcattgcagacaagatcgctgttttttatgcgggcacgacagttgaaattgcaccggttcaggattttattgcagggaaagaccatctgcgccatccttatacaaaggctttgtgggatgctttgccgcagaatgatttcattccaatttccggattacagccctatgcaggcagcttgccaagcggctgcccctttgcgccacgctgccggttacgcaccgatgcatgcaccggaacaatagaaatgcgtgaactgcgggaaggagaggtgaggtgcaagcatgctacttgaagtaaaaaatgtaagcttcggatattcaaaaaaagagatgatattaaaaaacgtaagtttcacagttagcaagggggagcgcgttggattggtcggcccttccggttacgggaaaagcacgctgtccaaactgcttgcgggctatttggtacccacagagggggaaatcctttttgaggggaagcccctgcctgcaactggctactgcccggtgcagatgatttatcagcatcctgaaaaagcaatcaatgagcggtggaaaatgcggcagattttggaggaagcgtggacgccggatgatgcgttcctgcaaaaaatcggcattgaaaagcagtggctggaccgctggccaaatgaattgagcggaggtgaaatgcagcgattttgcattgcccgtatcttgggaccgaaaacaaagtttttgcttgctgatgaaatcagcaccatgctggacgtcattacgcaggcccagatatggcagctggtgctttctgaagtaaaagaacgggaaatggggatgattatagttacacatagcaaggcgttgtctcaaaaggtatgtacgcgcatcattgatcttcccgctctcaacgagattcaacgttaagatatcaccgatataatagggatactaagtataacttgaaacaaagaatcgtctttacttatttgtaacacacctccgctttgaaacgcaatttcgcgggcacttttcaaaccaactccggcgctggaaacagtgtcggagttttttttcagtatatgattgcaaaaagacagcacaaatacatgctctgatctttggaagtatatttcaattggaaaagcgggatcggcatattttaaaaggttggaaaaaatgttatccaatattcgttgtaaggaagcctttttgatggaaaaaaactcggtttcttctttgggttttgtgaatacagattgaaacaattgtgattccagcatgaaaacaccatcttcgattaataagttaattgttgcgcagtcacaaaaggtatcttctgattgcgcttcatccatgcttaccataaaatgattaaacatattttcagaaaggttcttaagctgtagtgctttttcctctgccttatgaagatattgctgctgcagttttatatcaggaaagcgtttttgattcacaatatccaaatagccaattaaactggttataggggtacgcaaatcatgagacatatgcacggcaaattgatcacgatccttgcgtgccttttgaaaaagaataatttgtctaagcaaagcacagcgcattttatcaacatcctgagcaagagaggaaagctcatcatttcctctaagtgtaatcggattattaaggttgcctgcttctatatttcggatttcttttgcaagacagtgtatataaactacttttctctgcatataccaaagcataacaagcagaaagactaagaaaaaaacagccagacagatataattcaaattatcctcgaagcgatgacgcgcaaaagtgctgataactgcggttacttcaacatcacggaattgcaagggatacgttttttgccatggcaggggagcagttaacctgccgctcaataaattgcctgcatgataggaaattgttgaatcataaataagacggtccccataatataaaaacagagaggtcagctctcgttcctttacccaagcggacacaaaatgataatccagagcagatgcttgacaattgtcaatatgctcttgtaatttttgcagctctagatgttgctgctgttcggcaaaggcagcatcttgaaatttatgatcaatccacattgaacccatggaatgagcaacaaaaaaaatcagggttgcaatgataaatgctgataatgtacataaggctaacttcgagcctaacttaagactaaacaatctgatacccctccccccaaacagtgagaatgtatttgggatgctggggatctttctctactttttgtcttagattccgaatatgcaccatcactgtattgtttgcagagggaagatatggctcagcccaaagctcttcataaaggacctgcaccgaaaaaacgacccttctattttgtgcaagataagataaaagctgatattctttgtgtctcaaaaatataggtgaatcattcaaaaaaacttctccggaggttgggtgtatggccagctcgttaatctgaataaaatctgagtttaggcgggaatgttgtttgctgcctgagtaaatgtgataccttctgagcatggcctttacccttatcagaagttcacccggaataaagggctttgttaagtaatcatctccccctgaattaaatgcagtttctttatcctttggtaagcttttagcacttaagtacagaataggtgcggtcgtcaccctgcgcattttctcacacacagtaaaaccggaatctccaggcatcatgatatctaaaataatcagatcaatatcttttccaaccatggacactgcatccttcccgttgttggcctgtaatgtggaatagccctggctttgcagcaaggcggccgttacttcacatatatctttatcatcatctacgatcaatatagttgatgttcgcattaagcttccctcctgcatatagctgaatatatttagtaatgtgtgtatgctctcatattacataatacgtataagtttatttcacaatttcttttaatatataaatggattgataacagcttttaaatttatcttactttattttaacatagaaaatcttataatgtaatccaataatttgcaatgagattttgtgtgctagatacatttgtgaaatctttaaaaggtataaattgttagacaagtgaataaaaagtatggaggacatagagaatgagacttgatttccttataagagatttcaaggtatcttttgggtaaaggaggaaaatggcaatacctgtttatgttatcacagggagcctggatgcaggaaaaaccacctttttaaacaatatgtttgataaaaggaaagtaaaagctttggtaatacagtttgaggatggcgaagaagctctcttttgcggctatactggacataggaaactgaagattcccagaaggttattggaccagcagcaggaacagattcctaatcagatttacgaggttgtacaaaacggaggctgggaagagatttgggttgaatggaatggaacagcccctttttcctggcttttatcactgttttgggacccggtgttcagctcagtctgccagttaaaaaaggtaatccatattgtggacgctgagaaactggaattcctcctcagtggaatgggaatttatttaattgatcagatttcagaaagtgacatagcgattgtccgcaattaccataaaaaaagtcaatatcaacgtacccgccgtctgttggaagaggtgaatcccggattacaaattttagagatgacctcttacagcaaactttgtaagctggttttaagagagccggatggaccggtcagcacctttttcatggaatttatgcttatcatctgtttgtttcttctggcaggaatcatttccggactggagggattaccaatcagtagaatggtcaatctgttttttgggatgaccctgcaggcagttccctttttgcttattggaattttgctttcatctgtcattcagatactgattccggatggaatgctggaacgatggtttccaaagtctcttgttttgggaatggcagcagcattagccggaggatttttattgccggtatgtgactgtgcttcaattccagtttttagaagtctgattaaaaaaggaattcctctgccggtggcagtcacctttatgatggcggcccctgtcatgaatccagttgtgttgctgtcaaccttctatgcgtttggcggtaacatgacggtggtcgctggtcgggcaggaataggtgctttagcggcagttttgattggattgcttgctgctgttttccaaagagagaccccgctcctttcggggggtggacgaagccggttcatctgtgcgtgcggctgttatgaggacagtcaaaaagctgaatcactggcaggaaagctggtactttgtctgcgtcatgggcaggctgagttttttcaggtaggcaaataccttctgattggaatactggcagccgccgtttttcaggcgttaggagatgggccgctgactcttacacagtacagaggcggactggcagcttcgattctgttgatgatggcagcggcttttatcctgtcactgtgttcttcatctgatgcggtcattgcccgcagccttgccagccagctgccggccggggctgttatggggtttctcgtatttgggccaatgatggacattaagaatatgctgatgctctactccggatttaagaagggatttatagtgaaactgatgctggtaactgtcgcggtatgcttcttcctggtctttttgctgtatgggatatggggaattaggttatgaagaaaacagtcaaagtgttaaatcctcaggtgttaattgaaatcctatgtcaaatggtttttggaggaatgatcgtttatctcgctgcaagcggagcttatcttcggtatgttactccgagaatgaggccttatctgtattttaccgcctgtattttgggattatgggcattggccggaaccgggagattgttcaggccaagatataaaatacgcatgaaccactgtttcctgttaattatccctgtcctaattatgttgcttccacatacaccccttgatgtttcttcttacaataccattggtgaaggctcaaagctgcagataagtaaagcagaacgaaaagagcctgagcgtattccggatcagatggaggggacatctgacctgcagcaggagacggtttcattagaaaagccacctgccaaagacgaaaatgagaacgcaatgccagggctgaataaggaagaaaagaaaattattgtatcggatgatttgtttggaatgtggtattcagagctgtacatgcatatggaagaatacgaaggatataccattgtaataaccggatatgtgctgaaggatccagaaacctatggagaaaatgagtttgcagtcgctcgtctggcaatgacttgttgtgtcgctgatctggctcctgcaggttttctctgtgattacagggaagtaacaggtttaaaagaagattcgtggataaccgtagagggaacattgactttaaactacgaagattataatggacataagtatgcagatccttatattgcggtgacaaaaataacacccgcagaaaaagtggagggatatgtctatccgtattaaaattaaattgattctttaagatacaacgaaaagtctcttgacggttatccgtaactaacttataatatagcacataatgcaaatgaaaagcatttgcattatgtgctatattataaaaggacggggagaaatgaagtttagaaagattacggcaattataccggcaacagccttatgtatgtctgtcacggcatgttcccaaggtgaaaaacagccagaattcagctctggattaggctcagagataaaaaaggatgagatgtgtttgccagcacgaaggatatacgggatatcaatcctcatttatttttgggagagatggcgtcttaaatatggcttttgaatctttggcggtcaatacagctgaaggggggcagcctgtccttgcggaaacatggagaattggataatttgcaaacatagtgtaggtttgggagaaaagcagcaggttatgttgcgccctaatatacctggttgtgaaaggccagtcaccctaattagtgggggcgtgtggtgcggacattttggtattttggcatctgtgttctttctatgaacggtacaggctgtggctttacggtattcagctgagtatatccaccctgaaaaacattatgattgtaggcattccggcgggtatacaggcaatgcaggtaacccttttaaaccttattgtacaaaaacgtataaatcgccttagggataattgtaaaaatgctatctgaaaatctgcttaaataattgatccattacaaaggaaaacaataaataatagaaggaaaaggaagaataatactatgaaaagattatataggggattgtttttactggtgctcgcactgtgtgtgtctaacgcaaatacaccgttaaccgcaaatgcagaagaaacacattcggttgatccattgttttccgattcagagattgagataggtgcatggggaagtgtatcgactcctgtaacagaccctagttctctttttggagcagggcgcctgactatgctggccaatcatgatacagcggcacagcagttgtcagttatcatagaggatggagaaggcggactggtggtcattgatggaggttggaccgataatgcggaatacctgtttaatcaaatcaaacaaaagggggggcatgtaaaggcatggctactgacccatcccgatccggatcatgtaggagccattgcggaagttatttataggcatcgagatgaattaacgattgatgggatatattattcccttgcagaagatgaatggtaccagcagaaggaccctggaattgtgggaatggtatcctatttaagaggagcgctgtctttaatgccggaagctgtgcttcataaaaatttacaggctggggaaataattcatgcagggcctgcacagatacaggttttaaataaatcttacttgcttgaacaaaatccgattaacaacagctcagttacatacctggtctccttaaatggaacaaatgttgtaactttgggggatatgggagaagaagccggagagcttttacgcagggattgtaacttaggtgctttggactgcgatatagttactatggcacatcatggacaagagggtgtggggtatgaggtatacaaagacctgaaaccggaaatttgtctgtggccaactccgcagtggctgtgggataatgataatgggggaggcccaaacagcggcccatggaaaaccatggcaacccgaagatggatggcagaactgggagtaaaaaagcattattgtgttaaggatggagatcaaatcatagaatgaaaagcggcagatagtgtaagataattgctccttggtatgaatcatatcaatttaaatgctgcaagaggaagaactctatgctgttttgctttaaaaaaggacagtttttgctggagactgacttgacttgcataatagtcaggtatgcatttaattactgatgtcttcataatggtatcaaaggattcatatggtaatatcgagtaagagcccattatagttcataggatcagttttacttttatcggagataaatactattatggatgagaattttgaaagctggccttctggcataaaaagaactaaaccgcgtgaaagcatgcttactgtgcttagaaatgcagaaaagcctttaagttccattgaaatctttacagaaattcaaaaggatattaaaacggttgcgctttcaacaatttaccgttctcttgagctttttgtaaagaagggaacagttactaaattcgcgatcatgaataatgaagtagcggtttacgagttcaaccggtctcagcataatcattatgcggtctgtttagggtgccgggaaattttccccctgaaatactgtcccttggaaaaagtattgcctgagatggtagatgatggctttaatataaagggacataatttagaagtttacggatattgcaaagaatgtattaataaatgatgtaatggcaggcgcatgatacgcttgccttgtatctaagtaccttgagtacgggaagacagaaaccttgacaaagaggtcagaacactttataataagttattgcgaatgatgtgcgtttacattcaactggtctatagtaataatcatttatggtattggccgttagtaaggctgtaaaaattaaattttatgtaaataaggagtggcggacttctttattttttgaatttaagttagttttaactaacttcacaaagaactcttattatccaactccattttgaaaggagcaaatcatggaaaatccaaaaaagcaggggtgtcccgtctgcttgaatttaccggaaagtataagccgcttgtaatcgtttcctgcgtgctttccgcaatcagtgcggtaatccagttggcgccatttgtatgtatctatttcgttatacgggaaattctgatagcagctccggctcagtaacgaagaaggctgtacccagaatttgtaaaaaaatcacggaaaatgtagcaattgggagaccctggaatatattgaaagtagctgattatgaaaggaaatacagatatggctattagaatatttattgatcagggtcataatcccagtggatactttaacagcggcgcggaagcaaacggtttgacagaatcggaaataaattatcaggtggggctgtatttacagagcctgctgaataatgatccaaggtttgaggcacgtgtgtccaggccggaaccagatactgtattgggaacaaacaataccaccagcctggcagagagagtccgcatggccaatgaatggccggcaaactactttataagcattcacgccaattataatcctaatcccgcctataatgggacagaggtgtacatttaccaatatggcacacaggctcaatggctggcggaacagatcatggatggagtaacccaggtgaccggaacgagaaataatggaatcagggaaaatccctccttatatgttttaagaaatgcagatatgcccgcaaatcttgttgaattggcatatttgagcaatctttcggatgtggaaaagttacgtaatgacctatacggatttgcttacggcatttacttaggattgatgcggtactttggcttcgcttaacagacatggtatgaggggagctctttacggcagaccccggaatataagggctgtttgccgtgaagagtacataacacattatattattatgcatacagtatatggtgtttatctttctttttgcaacagcccctttactttcgcctttatctcaaattataatataataatcaaatattgtggatgaaacaaggagttgatagaatattatgcgctttaaaaaacatggttatggatgaccgtgaggatattcgtgaagttgttgcggttcttcacaacgtgacggagtggaggtgggataaatgagtctgaccagaggcgcaacaattcttattgtggatgatgatccggaaatccgggaaatcgttcgcattctgctgcaccgggaaggctttatcgtgcgggaagccttcgatggggagaccgcgttgatcatgcttaaatctcatgcagatttaataatattagatattatgatgccaggccgttccggcttagagctttgttcaatgataagagaaacaacgacaattcccattttgttcctgtctgccaaaacacaggataccgacaaagcagagggtttttcccgtggcggagatgattttctggtaaaacccttttcttctgttgagctgatatcaagggtgaaggcgcttcttcgcagatgccttatttaccaaaaaccggaaacagttgttaaaaatgaaatcagagcaggtgatctgcatatggatcaggacacaggaactgtctcacttgcgggacaggagattgtgctgacaagcattgagtatcaggtgctgcgactccttttacagaaccgaaaaaaaacactttctgcccgtgaaatttatgaacatgtatggcaggagccctttcttcccctttcaaacaatacggtgatggtacatataaaaaacctaagaaaaaaactggagaaggatataggccatccgcaatatatccgaactgcctggggaaggggatattacattgaataatacgaaaggcgaatgcaggctttcacataaattgctggtgtccgccattgcagcgtttcttgtttcggctacactatttcttatttcacaaaatatttcccgtaaaataatccatgtgtattgtgagcagccgaaagtgatatcccaacatattcaggaaaaagcagaaagccttcaacaatatgtgaaaaacagcaatctatccctgtcagaaatctccatgctggatagatggatggaaaaagaagatttgaccgaggttgctgtttaccgtaataacatactgctgtacagctctcacgcagtgtttccagggttttttcttgaaagccgtacacaggatatcaatttttcctggcaaaacggtcatacactgagctttgcagatggggaatccgttgcttttatcaatgatttatttgaacatcgctatacagactatgcagcctgcttaaacctgcttttattttttctatgcttcatcaccattatgatcctgttcattcgcaaaaaggtatcctacatcaatactctggaacaggagatcaaggttttggaaggcggtgatctcaattacacaatcaccgtaaaaggcaatgatgaactcacttctctggcacaggagatagatgagatgcgtaaagcgtttatcgcccgggaacagtatgctgacaaagtaagaactgccagtaaccaattgatgacaggtatttcccatgatttgcggaccccgcttacagctttgatcggatatctggaggtaatggagggtgaggcggttcccgccggacaaagtcccttcctacagaaatgcaaaaatcgtgcttttcagataaagagcctgacaaacaacctgtttgaatatttttttatatccacgagcattcatgaacagcttcagttcagaaactgtacagtgaatgaaatcctggatgaagtcattaacgaacacgtttttttaatggaacaaagtggctttaaggttaaaagcagtataaatctgccggctgtcagacttaaaatcgatcggggaatgatccagcgtgtatttgataacctgttttccaatatatgccggtatgccgatcccggctgcccaatccagctgaatattgttaccgaaccccaaaagcttacgcttatgatccggaatcatgttctgaactcccctgaaataatgcagagtacaggtcttgggctaaaagtctgtgagaaaataatgctgctgcacagtgggaattttatccacaaacagcagggagatacatataccgtccaactgcattttccgctcatctgacagcataaaaaaagcaggtgcgccgcaaaatgaaaaatcaaattgcggcaccctctgtcttttatcttcctgtcagtttttcccgacttcaagcacccggtcacaaatacggttgatcaggcttttttcatggctgaccacaatcaagcccagctgccggtctttgcatatgtgaagcagactgtgccatatcctggcctgtgtgatcgcatccagcatggtggtcatctcatccgctataagatacttcgtctcgggatgcagggcacgggcaatgcaaaacctctgcaattctccgcctgagagctcaatgggccagcggttcatccattcgtccctgatttcaaaggcatccagaatatcctgtgaaggcgaataggactcggtcagtacctcacgcatgcgccatttagggtcaatggccttttccgggtgctggtaaataagctgtaccggacggaatctgtgccgtttaaaaacgttattatccagtgttacacggccttcgcagggagaaacatatccggctaagattctggccagagtggtttttccgcacccgctgtatccggataagccaagcacttccccaggcgaaaccgaaacattggtatccttaaaaatccagcggtccttctgataataaaaccccaggtgttcaccggttaaaggcatgatgcgtttcctccttccttttgaaattccagatcaaagtcgttttgcggcaaagctctccacagtctgcgggtataatcggtctgcaggcgttggccatttccttcaaaagcagaggcttcggaaatctccacagtgcgtccgtcctggatgaccgccacacgatccgcgatctccagcgccgacatgatatcgtgggtaatcagcatgacacctgccccgttatctgcaaacgctttgagttgtttcaaaatctccgaaagtgcctggggatggatgccgggagtgggctcatcggcaatcaccagacgtatcccctgccgtacactggttgcaaacagtacgcggcgcagcataccgccagaaagctcataaggaaacaacctgctgtctctttcctgcaaatcgtactgcttaaacagctcaagctgctttctctttgcatcccctttccccagtccaatttgtacctgcttaccaacaggcataagagggtcaaggtaattgactgactgaggaataaaggaaatttccttccccgaagtttgcacttgcgctcttgcgtcagttccccgccccggtatgtaatatgcccttcgcatatggcgttgccgggaagtataccaagtatggcgtgagccagcagacttttaccggaaccgcttgcgcccacaaccgccacgatttcgccttcgctgatatccacatgcaaatccgcaatcggctgaatgacgcgtttctttgttcctttcaaatattgtgaaaagccaattgccagcttttccacctgtaaaagaggtgtttttttcatattgtccatctatcccccttactcattggagcttgcaggctccatcaggatacggagctgctcaccgatattgtcaaaactcttaataacaattaccagcagcaaccctgggaagagcaccagccaccattttccggtggaaatatggctcattgcttccgaaaggatgatgccgatggcaggagtctggggagacagtccaaaccctaaaaaggtcagcgcagcttcatgcaggataacatgaggaaacatcagcagaaagccaatcatgatctgtggaaatacagacggcaaaatgtgcctgcaggcaatataccagggcgattttccatagctttgggaaatatggatatactccgcactcttaatttgcagtacctccgcccgcaccacacgggccagagacatccagtgtgtaaaggataccccaagtacaatgccgcggataccgccgcccataataaaagaaatcaagatcataaatacaaggtggggcattccaataaacaaatctatcacccatgaaatcacattatctgcttttttcccgaaggtggctgctccgattcccattacggttgcaacaattacgctcatgacagaagcaaatgctcccaccgcaagggacaaacgcagccctttcatggttcttgtcagcatatcacgccccagccagtctgtgccgaatggatgctgtgtgcttggggggaggttttttcccactgcgctcagccgcaggtttgcatcactgagtgtgaagccaaggatgaggatgatcagtaaaagcacggaagaaattgcaagcatccgcatcatttttctttttacattctgttctttttttttcttatgcatcctactcagctcccttcatgcgcggatcgacaactgtgtttaatatatccgcaataaaattacccagaaaaacaaacagggaactgatcaggatgatccccatcagcaggggcagatccccctttaatccggcagtggtcagggtactgccgagccctggataagcaaatacctgctccgccagcaccgagccgccaaacagctcgccaaaataggcaaattgcagggacatggcagggatgatggagttgcgaaaaccatgatttttaaaaatttgccatttgctttcccctcttgccttggcaaacagtacatactcggtgttgaaaatatcgatcattttttcacgggtatgcatggcgatattggcaactcccaggatgcttaaggtgagggcaggcagcacaaaatgccgcacccggtcaatgaaccgcacctcgctgtcaagaacgccggccggtgcggcaagtcctaccggaaaccatttaagacctgccgcaaaaacaatcagaagaatcagccccagccagaagattggggtggagaccagcgtgtagctataccacttgatagccttatcaagtggtttcccacgattcatggccgaaataacacctaagagataccccagaatcccggacagcacccatgcggttcccatcaatacaaacgaggtcacagcgcggcttttgatgatatcaattacagggctgcggtacagcttggatatcccgaaattcccctgaagcaaagatcctgcccaagaaaaatattgttcggccgggcttttatccacccccaatattccttgattttttcaatctgttcgggagatgcggagctgtccccgccgacataagcatttacagggtccatgggcgataagtgaaccagagtaaaggtcagaattgatagcccgataattaaagtgatcatgcgaaacagacgaatcagaattatttttgtcacgaaacttcctccttccttttcgcagtgtctttttaaacattaacggatcagtcttcccatgtccactccgtgatgtttccaaacagagcccattcatggccgtgagagtgaatcggctgactgcccacattcagcttttcgtttgccagatacaggtgatccacacgtgcaagccagatgataggaatgtcgccgagtgtgccaaagcctgttttgccatcccactgcgccagcttccaatacttgttggcttcttcctgggtcgctgcgtgcatggccttatacagatattcatccacagttggattcgtgtagtgggtcatattattatatccctgattaagaaccttggatgaatacatggtatacaactgatgggcatggtggcgcccaccgccccacattactgcgttttccttacctttgacatatatctcatcccaggtcattcctttggcattaatcttaatgccgaattccagtgccaaatctgccacagccagagacatgtcgcttcgaagctggtcgctggagctgaacagcaaatcaaactctgctttcaggccatccttttcaacaatgccgtccttgtcggtgtccacccacccgccgtcagcaagaattttcctggcctcttccatatttccgtcctgaatgacggtttcctcgttaaaccagggtaaatagtcacaaagcgagaatgccttttgtccatagccatccagtgcaatatcaaggatcgaatcgcggcttaatcccacacttaacgccttgcggatagccaggtcagaggtcacatcgttccctacattgacatcattttcgttgatctttccttttcctccgcttttttgtgtgggcatggagattccccgtgaatcaatgctctcaaatttaagaagggtcatgccgtccacagcctggtctgcaaacgtgggcggaacataaacaatatcggcttcccccgccttagcagcagcaagagcagcatcttcttccagaaggagaagcgtcagttttttaaactgcggctctgttccataccagtattcattgtattccatgatgatctgctgtccgtcattatactgaacaaccttatagggaccggagccgatgggattaccggaataattgtcgtcgtataaatcctttggaacaattcctatttcggtaagctggctgacaaaggtggaacgcggctcagacagcgtaataacaattgtgtgcgcatcctttgcctcaatggacttcataaaggataaatcaaattttaccccgtccgcctgaagcatttcatatgtaaatttgacatcctccgccgtaaccggattgccgttggagaatttcacatcatcccgcaggggaaaggtccatgtcagcgcgtcctcactgacctcataggactcggccaggtcgggaacaaaattcatgtcggaatcaatccgcaggagagagctgtgggtcagacggatctgcgcatgggtgccccagccctttttggggtcaaacataccggtatcggttttacctacagccagaatcagctcgtccttctttgtggtggattccgccgatgtttttgattcttccggtgcctgagatgaagaggaaggctgagaagaagaggaagaagagccgcaccctgaaacgatagatgcaaacgttaaaatcattgccataagaagcggcatgatccgctttaagggcaaattttggggtttttccatttttttacctccgtataataatgttttgctgtttaattgatccatacaaattttaatgtgcatggatcaatcagttaatcatgtctaactataataaacagggccggtaaattcaaccagttctccgtattcttcaggattcttcagaattctggtacagaattaattatggaattttatgagatagcaggcggatccattctttttctcaactatatccctgtatacttgattctatgagttagattatcctaatcataaatttaccggagttgttccatattgcattacctggctgtaataccatagttgaacaaggcattgctactggggtcatgaatgcaaccagaaatacggcagtaatctcaaaagactgaacggcttccttttctgaaactactttggcaagcaccagtattacggcaccaacagtagaagttatatacagcggaataccgatggaatcctcaaaaaccatacctaacactgcgataaccaagataattaatgataaatattgtttccatgcaggaacattactataatccatttctttattgataaactcgttgctggaatctttgtttggcagaagtttatgtcctgctaatagaatgtaaaggattcccccagccaaaagcgggattccactttgctgtattcaaagaagccgaacttcatgccaccattactataggaaatcaatgcatcattgacgatcatatttggcggagaaccaattaaggtaatagaacttcctaaacctgcagctatttaaaacttatcaggggattgcccaggacttggagagcgtaaaagggcaactcaattatgtgcggggaatacaagacgattatgaaactgcaattgtacgctccgcactttcacagttgcagttataatattatgatatgaatttggtttttggggttataattcatagaccagatctctcccgttatcaatttgataatttggtggagttctggtctttctgctgcaatgtttaagaaactattcatatagcttttcaatgaattgtgtgagataatgaaattggagataaccaaagctcgattgcggaaatgaaaatagagctttcccgcattcgcacatggtcagagatttccgatgagagtgatatggaaataaagaagatggtaaccagtcacattataaaacgggtcaatgtctttaaggattacaaactggatattgaattaaacctggatatacaacaatttctaaacggaattgatagcataactagagaaacatcaattactaaagtatcataagtaaaaacacatttataatagctctttacagctgagtaagtattactaacgtataaaaagatggtttgtgggggtgcacatccgacatatcgggagagcgcttgaatggcattcaagaggtcatgggtccgaatcccactatcttcatttaaacaataagccgcaggcatgcttgcggctttattttaacttaaagagacggctccttttccggcccttcttattatattcacttaatatatctgatgaccaccttccaaagcctcatccagctgtttatcggtgcatcgtcttgccgcctccgcatcacggtctttgaggcatttatataaacaaagtacgctgtcgtatagtgcctctttcccgtaacgcagacaaaaacgtttccaaagctgtgttacaacaggtttaaaagatatgtaaattaaaggaataatactgtttccgctgataacggaaagtctgtgatgaaaagaaaaggtggctgataccgtttcttcaatcgaagttgcatctgcaacttcctctaataatccttccaatccaagaatatcctcattggatgaattctttataatggaatccgttgccagatgctccaatgcccggcgtacttcaagtatggagtaaatttctgcctgtccaagtgtatctccgtgatattccataatggcatttaaggtattgatatttccgttcttgccgtaatctgctacaaacactccctgccttggatgtacttccaaaaagccctgtttttcaagttctgcaaacccactgttaaccactgcacggctaacctgcatctgtctcgcaatctccctttcaggaggtaatttgcttccaaccgggatatgccctgataaaatcatgtcacgaatctgacaaataaacatttcttttaagctggaagcgctaagtttctgaaattccatgttttttcccccttattctggctctggtcataccagaaatcaataccattttatcatacattcttacaaaaattcaacaaataaatatgtaaaaatgacgattaatttttacattattgctagttttcatagaataatttataatgatattgttaaaaaataaactaggctattcgcctggctgaaccagagcacttatgaaaaatattccttcctcttgaaggctgaaagacctttgaagaaaaggaaaatgccaaaaagtgattctaaagcaacagatgacagaaaaggaaaagaaaggagcgcaacacatggaagattttaaagttcttgagataaaaacaagtgtctttgctgacaacaacatacaagccggaaagcttcgtgaagaattaaaggagaagaaggtctttcttcttaatctgatgtccagtcccggtgcaggtaagaccactactctgacccgtacggttcatgccctaaagaacgaccttaatattggtgttatggaagcggatattgattctgacgtggatgcccgtaccatacggcaaaccggtgcaaaggcgatccagctgcataccggtggtatgtgccatctggacgcggaaatgacccgccagggattagaggggcttggtacagacggtctggaccttgtaatattagaaaatgtgggcaacttagtctgtcctgcagaatttgataccggcgcagtaaaaaatgctatgatcctatccgtaccggaaggagacgacaaaccacttaaatatccgctgatgttttctgtttgcgatgtagtactgatcaataagatggatgtaatgccgtattttaattttgacctggaaaaatgcaaagtgaatatcagacttcgtaaccccaacgccatcatcattcccatcagcgctttaaaaaatgaagggatagaggaatggaccggctggttaagcaatgcagtaaaatcctggtgtgaataacaaacgtataactgtcataaaaaggtattcataaacttcaattgcgtaaaacaagcgcgggaaaggaaattatgagtgaattaagacctaaaatagtaaagctggcgaaaatggtaggcggtattgccggagccatgaacaaaatcgatgaaaattctcccgaatactacgctctaaactgtgttgtaacagatgacatggctgatattgctatgattatagggctgcgtaaaccccgtaccttcgagtatgtcgctaagcgctccggaaagagtaaagaagagacaaaggcgctcctaaagcagttaacgtacacaggtgtcgccaaagtatggaaggataaggaggatcataaagaacggttctttgtgaatatatttgcccccggtatgttggaaatgatggtaaataaccgggaacagcttaacgaacatcctgaaatcggcaaagcctttgaagaatataccagactgcgtcttgcgcctatggcagcaaaattcccgcaaggcatggcaatgatgcgtgtcattcctgtggaagaggccatcaaggatatccctggtacaaaaccctgggaacgtctctcttattatctggataaatatgatacgttctcagtatctgactgctcctgccgccagtcacgccgtgtactggatgagggctgcggccatctggaaaaagaaatttgcatccagatgggcgaaggtgccgaatattatataagaacaggcagaggccgccagatttcacgggaagaagcaaaggaaattattaaatttgcagaaaataacggcctcatgcatgaaatgccccataccgacggacttggtgaatcagcggcaatctgcaactgctgtggctgctcctgcttctccctgcgtcttgcaacactttttaatactccggattccatacgatccaacttcgctgccacggtaaaaaaggaaaactgcgtagcctgcggacagtgtgtggaaaactgtccggttaatgctttaaaacttggccaaaaactctgttctaaaacacccgctgccataaaggcagaacctaccgcacgtgatcatatctggagagaaagcaactggaatgtggattaccgcgagaaccgtaaagatgttgcggaagaaggaacttctccctgtaaaactgcctgtcctgctcatatttccgtacagggttacataaagcttgctgcttccggccgttaccatgaagcattagaactgataaagaaagaaaatcctttccctgctgtctgcggacggatctgtcctcatggctgtgaaagcgaatgtacccgcggagatattgatgaaccggtttccatcgatgaaatcaaaaaatttattgcagataaagagctggatggttcgatccgctatatcccgccaatgcgttaccatcttggaaataaaattgcagtggtaggctccggtccctccggtctttcctgtgcatattacctggcaattgatggttatcaggtaacggtatttgaaaaggaagaaaaacttggcggtatgcttacccttggtattccctccttccgcctggaaaaggaggttcttaatgccgaaatagatgttctgcgtgaaatgggtgttacctttaaaaccggaattgaagtcggaaaagatattactcttaatgagcttcggaaagaaggttatgaagccttttatctggcaatcggcgcacagggcggcagaagtcttggtatcgaaggggaggacgctgaaggggttatctccggcgttgatttccttcgcaatgtaaatcttggaagaaaggcagagttttccggaaatgtagttgtgatcggcggcggaaatgtagcaattgatgtagcccgtacaggggtaagacagggggctgctgctgttaatctttactgtctggaaagttccggtgaaatgccggcattaccggaggagatcgcagaggctgaggaagataacgtttcctttcataatggctggggccctaagcgcatcctgacagaagatggaaaggtaaccggtgtagaatttaagcgctgcatcagtgtattcgatgaagaccagcgtttcgctccaaagtacgatgaaaatgataccattactgtggaagctgatactgtactgctttccattggccagaccatccagtggggcggacttctctcagaaagcaaggttgaacttggacgcggcggtactgccaaagcggacagtctgaccttacagacttcggaaccggatatttttgccggcggtgactgttttacaggaccccaatttgcgatccatgccattgcagccggaaaagaaggtgcaatctccattcaccgttatgtacagccgggacagtctcttgtatatggccgtgaccgccgggaataccatgcgtttgataaaaataacgttgccatcggcttacaggattttgatacaactccccgccagagaccaggccattctcctgagaaaaaaggcagcttctatgatgaacggttgaccttcaccgaggaacagttaaagaaagagacggaacgctgtcttggctgcggtgcggtagaaatcgacgcttatatgtgtattggctgtggcatgtgtacgaccaaatgtaaatttgatgcaattcatctggagcgcacctataacacggttcccaatacctatgaaaaacttcctgtcaagattgctgccaacgcaattatacgtaccggaaagattgctgcagccaccctcaaagaaagcgttggcagaagaagctaacgggaaagggagagtcagtcatgcatgagcttggtgtattaaactcaatggttcacaccattgagcgtattgtaaaggagcagaatattacagaggtccacaagcttgtcatcgaagttggtgagctttccggtatcgtgcccagatacttggagcaaagctggcctgctgcctcctataaaacttttatggaaaaaacagagctggagcttatcgtcattcccggtattgtgaaatgcaaaggctgcggcagggtatttaatgccgtttacagtgatttaatttgccctggctgcggcagtatggatatggaaatcctggagggcgatgacatgatcattaaggagatcgtgtgtaactaaaggattctgacgatgaagtggcgaaggctgtgaaagaagggatcgcaattcgtcacaggtgaatgccagaatgctctcatgaattaaatatgaaagaaatagaagcgtgtaaaacaaggaggaatgggtatgtttgtgttttcagaaggtgttccgacaatattggttttactggtatggcttggggtgtttctatcgttgtttgccgcaaatgaattgagccgccgttttaaatgggtgggatttggctgctttgttgtgcttccggttgttttaaccgttttatgggtgacaacgctgaaggatacttcttatatggactggtttcatctggcaaaggtttactcttctacggcagggtgtattggcttttggtgtatccgtcatatcaaaaagctgcagcataataaaattgcgctgtgtttcccgccgttaattctggcggtcaatatcctggaagcctgtttccgcgattttgaagtaagccagtatgtatcaccggttatggagtatatgaacaatcaggttcagtactatatcggcggttcatggaatgtcatgaacgggatcgcaggtcttttgaatattgtgaccattacaggctggtttggaatctgtattcgaaagaagaccagtaaagataagagccaggatatgctttggcctgatatgatgtggttctggattattgcctatgatttgtggaattttgcttatacctataactgccttccgactcatgcatggtattgcggattagcccttttgctggcccccacaatttgtgcatttacagtggggaagggggcatggctgcagcaccgtgcccagacgctggcactgtggtgcatgtttgcccagacgtttccggtatttcaggatgccagcagttttctggtgcattcccggtccagtaaggctattgcagaagcagcgatacgggaaggaatgctttcccctgacgggtatacggtattgaccggaataggaatccaaccggtggcaggtgtatcaccggataccacttttttatttgttataagtttgctggctcttcttgcaaatatcggagtatttgtatatatgattcacagaatgtataagacaaagagaaatccatataccggagaattatatacggatcataagaagtatcaggaaattaaggctttggcagagtaaatgaaacggcaggaaacgaaaagtcactgaataatcagagatttgatcgttgcctgctgttttttattctacaaccttttcctctgcttcaggcagaattcctccggattaaagtcgtggcaatttcaagtttcacggaggtggcatccggttcttccatgcggctaatgagtctgttggcagccattgttcccatataatgcttaggcacatgaatggtagtgagggcaggatccacaatgattcccgcagggatgttgtcaaagcccacgatggagatatcctccggtatccggtagccacactgcttaaatgccttaagggctcccatggcgattaaatcattgtccgcaaagtagcagggagccagaggttccttccttttaaggatttccagcatatccgcataagcgccttctatggaaggagtgactgagtggacaatgctgttggaggcggccattccataggtgtgaattgccttaaagaagccggaatgccgttctgcaaaatttccgatcggataggaggaatggagatagccaggctgttttccggttgtttttatcaagtaagaagcggcaaggaaagccccctggatgttgttgataatgatgctgtcgcagggaaccgtttcaaaatagctgtccagtaagacgatcggaatcgtgagggaccgaaaaggaagaaaatcttcaggtgtcatttcggttcccaaaaggatgattccggtacagccggagtagagcatatcttttaatcgattttcaatattaccttcctcaccgtataaataacggatttccatcttgtaattatttttctggcaaccggccgcgattccttcggaaagctcttgaaaaaaaggattgcttccaacgatagctccgtgttttttataaataattaagtaaatgctgctcacgtcccttgggcgaaatgtgtgacgggtcaaatcataatcaaacttctgggctgtttcgatgaccctccttcttgtttccgtgctgacgcctggcttgttatttaaagccatggatacggcggcagctgaaaggtttaatattttagccagctcttttgcagtaattcccatagatgtacctcctgatcgttctgatatcattatggtctattaagtggaaaaaggcaagaattaagttaaaaattcattaataaatactgaatatcataatgaaattaagttatgtaatctgtataatttatatatatgaaaagatcgttcagcagaaaggatggatgttatggcgactataaaactggggttcgcccccacaagaaggagcattttcagcgctccggatgctataaagtacaggaatttgacggcggatagacttgaggaactgggagtttctttcgtggatattaaggatatgaacgaagaagggcttctctacgatgacagccatgtaaaaatcatagctgaaaagttcagggatgaaggaatcgatggactgtttctccctcattgcaacttcggaacggaatacgtttgcgcgagactggcaaaggagcttggagttccggtcctgatttgggggccaagagacgagaggccggacgaaaatggaattcgcctgcgggacagtcaatgcggcctctttgccacaggaaaggtgctgagaagatttaaggttccctttacctatctgaccaactgccggctgacggacccggaatttgagcggggaatccgtgattttctggcggtctgcaatgtagtaaaagtatttaaaaacacaagaatcctgcagatagcccccaggccttttgatttctggaccaccatgtgcaacgaaggcgagttgctggaacggttcaacatacaattgtccccaattcctatgcctgaattaacctccgagatacaacagatgaaagaggagaggacagaggttgaaaagatcgtaaaggactgcaaagagtccatgaatattaaaatcagtgaagaggcactgttaaatgtcgcggcattaaaggctgccatgaaaaatctggcagttaagtacggctgcaacgcgattgccattcagtgctggaatgctcttcagggagaaatcggcattatgccatgcggagccaattccctgttaaatgaagaaggaatcccggtggtctgtgagacagacattcacggggctgttaccgcagttatggcagaggcggcgggcatggatgaatgcagaagtttttttgcggactggaccgtaagacatccggacaacgaaaatggagaattgcttcagcactgcggcccatggcccatttccgttgcgaaagaaaggccgaccctgggctaccccctggcctttgaccatccgggagctgtggaggcggaggcaaagcatggtgagatgaccttgtgccggttcgacggggataacggggaatactctcttttacttggaaaggcgaagggaattgatggtccatacacgaaaggcacttacgtatgggtggaggtagcaaacttaaagaaactggaagcaaagctggtggaagggccttatattcatcactgtgtgggtatccacaaggacattgttccggtattatacgaagcatgcaagtacatcggcgtgaagccggatttatatgatgacaacgaggaagagatcagggcctatttaagaggagaatgatatggacggactaaaggcaaagacctatgaactgagaaaatctgtgatagatatgattatggaagggaaagggggccacatcggcggagatatgagcgtcatggatatattggccgtgctgtatttccgccagatgaacataagtccggagctgatggaagatgagaaccgggaccggtttgtgcttagcaagggacattccgtggaagctctgtatgcggttcttgcagcaaaaggttttttccccatagaagaagtcataaagagtttctcaaaattcggctccaggtttattgggcatcctaacaacaagcttcctggcattgagatgaattccggctctctgggccacggactgcctgtctgtgtaggaatggctctggcaggaaagatggacgggaggtcctaccgggtctatacagttatgggcgacggagagctggcggaaggatcggtatgggaaggggccatggctgccagccagtttaagctggataatctctgcgctgttgtggaccgcaaccgcctccagatttccgggaatacagaggaggtcatggggcatgatgaccttggtaatcgttttaaaagctttggctggcatgtaatcgacgtggcagatggaaacgatgtggagaaactgaacgacgcatttgaacaggcaaagacagtaaagggaaggcccagcgttctgattgccaacacggtgaaaggatgtggttccccgataatggaaaataaggcggactggcatcatagggtgcccactggagaagagtatgaggctataatggctgatttggaaatgagaagggaggcggcagtatgaatcaaatacccaacagacaggcgatatgtgagacattgtcagcgcaggcaaaggaagatcatgatatcattgtcttgtgcagcgattcacggggaagcgcatccctggccccatttgcacaggcatacccggagcaatttgtggaaacaggaattgcggagcagaatctggtcagcatttcggccggattggcaaaatgcgggaaaaaagcatttgctgcttctccggcttgctttttgtctgccagaagttatgagcaggcgaagatagactgtgcttattccgacacgaacgtgactttaatcggaatcagcggcggggtcagttatggagctctgggaatgagccatcattccgcccaggacattgcagctatggccgcagttcccaatatgagggtttatctgcccagtgacaggttccagacaaaacggctgatcgaggaattgttaaaggatcagaagcctgcttacataagggtgggaagaaatgcggtggcagacatttacacggaggagaactgcccctttgaactggaccgggccaatgttctttcccttggaacggatattgctgtcattgcctgcggggagatggtaaagccggcgctggaggccgcagagctgttaaagaaaagcggaatttcagcatccgttattgatatgtactgtgtaaagcctttggaccaggaggctgtattgcatgcggcagaacgtgctggagcaatcatcaccgtggaggagcattccccatatggaggtttgggttccatggtcagccagatcgtcgcagcccactgcccaaaaaaggtgatcaatttgtctcttcccgatgcccctgtcatcacgggaacctcaaaagaagtgttcgagtattacggacttacggcagaaggaatcgcaaaacgggcaagggagctgatttaacatggcaaaatatattctggcggtggaccagagcactcagggaacaaaggcacttttatttgatgaccatgggaaactggtaaaaagggaggatgtgccccacaggcagatcgtaagcgaagagggttacgtttcccatgatccggaggaaatctaccaaaacacgttaaaagtggtacgaaagctcatgaaaacctccggagttcctaaaaatgagattgccggtctgggaatcagcaatcagcgggaaactgcccttgtgtgggataagaaaacaaggaaaccgcaagccttggcaatcgtatggcaatgcgccaggtcaagggacatctgcaaaagaatagaagagaccgttgattcggaaattatacggaataagacaggattgatcctttccccttattttcctgcttcaaaatttaaatggcttctggaacatgtggctggtctgaaggaacgggcggagaaggaggagctgtgtttcggaactgtggatacgtggctggtttaccgtctgacaggcggaacttcttataaaacagactattcaaacgcttccaggacgcagctttttaatatcagggatttggcctgggatcaggagctctgcaagatatttggtttaaaaagccagtggcttgctgaggtttcggattcggactcatgctttggaatgacggactttgagggactgtttgacgcacctattcccattcacagcgtgatgggagattcccacggcgcgctgtttggccagggctgcttaaaaaaaggcatgacaaaagcaacctatggaaccggatcttccatcatgatgaatacgggaaaagaaccggtgttcagcacccatggagtagtgacttccttagcctggcgcatgggcggaaaggtgaactacattctggaaggtaacatcaattatacgggcgcggtaattacctggctgaaagagaagatgaacatgatttcctccccggaggagacggagcagattgcagcagcagccgaccaaaatgataaggtctacttaatcccggccttcaccggccttggagcgccatattgggacagccgtgccaccgcttccattaacggaatgacaaggaccacaggccgggcggaaatcgtcagggccggactggaaagcattggctaccaaattgccgacgtaattcaggctatgtgtgaggacatgaactgcatcataacagaactgcgggtggacggaggtcccacgggaaaccagtacctgatgcagtttcaaagcgatatcctgggaacaaatgtgcgtgtctccgaaataaaagagctctctggaatgggagccgctttcgccgcaggcctttcccttggcatttatcaggaagatatatttgaaaaaatgaaagcaaagcaatataatccatgtatggagccaggagtgagagctgagaaatatgagggctggagagaaacggtcaggaagcttctggcttaattacagcggacaacgataatggaatgggagagaaagcatgctgaaagtgtcggaaataacaattgaatatttgaaaaatccggtggggctggacggcaggccatggtttggctggattctttgcagtgacaaaaaaaatgtaaagcaggaagcgtacaggctggagattgccggggatgagaactttaaaaccatggtttatgaaagcggctgggttaagagccgggagtccatccatgtggaggcagccgggttttgtcctgcttcctgtaaaaaatattttgtccgggtgcaggtgcaggatggagaggaacaaagcagtttcagtgaaccggcgttttttgtcactgcagtcataaaacaagaccaatggaaggcccagttcattactgcggaaggaccggaggataaagacttctcgggaagcacttatctgcgaaaggagatcgaagtcagcggtgaaatgctggaagcctatgcatgcaccacagcacttggactgtatcatttctatataaacggacataaggtgggccaggacgagatgacccctggctggacttcctatcagaagcatttgtgctatcagacctatgaggttacggatctgctgaaacagggagccaatgcgcttggagctttggttggtgccggatggtataaagggaaaatgggctttcttcatctgcgtaataattacggagaccaggcgtcttttctgatgcagctggtggtccgctaccgggatggccgggaggagacgttttttacggaagaaagctggctgggccatgagggccctgtgactttttctgagatttatgacggggagatttatgacgccggcatggaaattgaaaattggaactgtcctggctaccgcgcagatgactggaagggggtagaaacgattgagtttccaaagagtgctttgaccgcccaggctggttcgaaggtaaaggtcatagagactctgaaggcaaggagtatcttccagacgccgcagggagaccgggtcattgatttcgggcagaacttaacgggctgggtacaatttaaggtgcggggaaggacaggagaagaggtaagatttcaatgctttgagacgctggattcttcaggaaatgtttatacagccaatcttaggtcggcaaaagaagaaatccgctatatctgcagaggagtaggcgaagaaatctatcatccccatttcaccttccagggctttcggtatgttcatgtcctggattggccgggggaactgaaagaagaagatgtggaagcctgcgtcctgcattcggacatggaagaaaccggagaattttcctgttcccatcctttggtaaaccagctccacagcaacagtaagtggagcatgaaggggaattttctggatattcccacggactgcccccagagagatgagagaatgggctggacgggagatgcacagattttttgccgtacttcctgttatctgatgaatacctatacgtttttcagaaaatggctgaaagatgtggccgcggaccagacgccggaagggggagttccccatgtggtgccggatatcataagcggcagggaaaaagacgactggctgctttcaaagggaacccattccgcggcagcctgggctgatgcggccgtgatcaacccatggactttatatctgatgtatggggataaggtcatattggaagagcagtatgacagcatgaagcaatggatcgggtttatgagaaaacatgccagggatcatatctggaattataaactgcagtttggagactgggtggcgcttgatgcagaggagggcagctatttcggagcaacccccaatgatctgacctgtaccgcatattatgcatactcaacaggactgtttgcgaaaatagctttgatcctgcagcgggaagaggatgccagagagtatgaagcattgtatggagaaattgtaaagaagtttcagagcacattttttgagagtgacggaagcatgacggctatgacccagaccgcccatattctggctttgcattttaaccttgttccggaagcatacaggcagaagacggccgagcagctggttacactccttgagaaagagggcggacatctggtgaccggctttgtgggcaccccctatttcctccatgcacttagtggaaatggttatgcggataaggcttatgagctgcttttaaaggaagattttccttcctggctgtatcaggtcaagagggggcgaccactatttgggagcattgggacggcttaaagccggatggaaccatgtggagtccggatatgaactcttttaaccactatgcctatggagcggtgggagaatggctgtaccgctctgttctgggaattgaaacggatgaggtttgttccggataccggcgtatcatcatcagcccccagacaggagacgccttagcatatgcaaaaggatcatataaaagtgcacttggaatgatccggatcagctgggaaaaaacgcagacgccgggagagcggcggcttgcctttgccgtgccggccaatgcagcggttacaatacgtctggaaaaaggggcagtgccgtatgaaaccgatggtcttgcctttcagcttaaggaggggtgtatgacggctgaagcaggctccggaagctttgaaataatttataaaaaacagtgaggaggagaacgatgctgacagatttaaaaagttcaccctttgcccgggtttgcggtcttccctttcccgcggtgaaatggacaggcggactatacaaggaacggcttgatacctgcatgaattctacggttccccatctgcaaaaaatgtttgagagcaaagaaatcagccatgtgacggaaaattttaagatcgcagcgggtgaatcagacggtgattttgacggcactgtttttggagacggcgatttttataaatggatggaatctgctgtttatacggcggctctgggagaggaccggcagcttttggaagagcttgaggattatgttggtttgatcggcagggcacagatgcctgacggatatatttccacaaaacagattatcagtgagaagaaggggaaggccgcaagacttggagatatcaacgaatttgaagtctataatttcggccacctgttcaccgctgcctgcctgtatcaacgggtgacaggccgggacagctttcttaccattgccgagaaagccgccggatatttaaagcatctgtatgaagaggccaggaagagcagggaggcacagaccgctgtatgcccttcccattacatggggctggccgaattgtatcggacaacgggaaaacaggaatatctggatttgttaaaagatgcagtggagctgcgggactgcataaaggaagggctggatgacaaccaggacagacttcctcttataaaacatgaaaaaatcatcggccatgcggtgagagccaattacctgtatgcaggagtggcggatttatgcctggaagaggaaaatccggaactaacggaggtccttcataaagtatggcacagccttgtgacgcagaagctctatataaccggaggatgcggcgctttgtataacggtgcgtcgccatatggaaactttttcacccaccagctggtccatcaggcttatggatatgaataccagcttcccaatgtgacggcttacaatgagacctgtgcctctgtgggaggcgtatattgggcataccgtatgttctgcatggagaaaaaagaggagtatgcggaggttctggaacggatggtcttaaatgggaacctggcggcagtcagcctggatgggaagagattcttctatgagaacatgctgcgccgggcaaaaaaacttccttatgagctgatctggggacaggagcggacggaatatattttaagctactgctgtccgccgaacctggccaggctgattgcccagctgagtgaatacgcttacactttagatgataccggcatttatccggtattatacggtgccagccgggcggatataaagctcctgaatggctgtgaaggtgttctggttcaggaaacggactatccatatgacggaaaaataacctttcgctttgaagacatgaagaagaatgagccggtgaagctgcatttgaggatcccgtcctgggtacggggagaaagcggggttcagataacggaaaacgggcagaagtgtatatgggaaagaaagctctcggctgcggacaggggcagttttctgactgtggaaatagaggatccggaacataccgtgatcagcctggatttagggatgaagccccgtctgacctgctcccatgctctggtggaagaaaactgcaatcaggtagctgtggagcgggggccactggtatactgtctggaaggcatggacgctccggcagaaaccattgacgatctgtttgttccgtcagacgtacggttggagccggaggagattgagatagaaggccggaaggtgaccggacttggggccacgtttttaaagaaaattaatggaccggaatatgacagaaattccctttaccaggattactctgaggaaggctatgaaccggtcccggtgcgtatgattccttattttgcctgggataaccggggtctggatgagatgcgcatctggatgcccgtagtcagaaacagatttggcagtgaaaagcaaggttgaggaggcagatcaatgttatatggagtatcctattacccggaacataaaagcaaagaagagcttaaatgggatttaaagctgataaaggaatccggaatcaatacggtccgaatgggggagttttcctggtgccggatggaaccggaggaaggaaaatatgacttttcctggctggacccggtgattgaggaactggggcaggccggcatccgtacgatcgtaggaacccctacggcatgccccccggcgtggatggtggaagcctggccggacatgttatatcaggataacaggaggattcgccgtcctttcggaggcagaagacatggatgttatcatcatgaagcgtacaggaaggcctgtgccggcatcgcagaagctgtagggaagcattatggcaggaatccctatgtggcaggatttcagattgacaatgaactggctcaggaaggaacgggcagatgtacctgcgaaaactgccggaagaagtttcaggattggctgaagcagaaatacggcgggatcgaaacctttaacaggagaagcggtgccatcttctggtcccaggagtaccggtcctttgaacagatcaatccaccggtcaatgccattgagccgggggcgcagatccagattcgggacttttatgaaaaccccacggtccgtctggagttcgaacggttttccagtgaaagccagatcgagtttcaaaacattcaggctgatatcctgaaggcttttacttcgtatccggtgaccaccaatggaacgggacttgtgaccaacagcattgactattttaaaggctttgaacagctggattgctatgcctttgattattatcccaatctgcgaaacgcctgggtagattccttcccctatgcatttggcagaggggtaaagcctgaccaaccgttctgggtcatggaatttatgtccggaggaggccacaggctgagcgggacgggacggctgcagcccggacccggtgcattgaagcaggcggtggtccaggcatttgccaatggtgccggtttacttttacactatcagttccgcagctttccggcgggggcagagcagttaaactatgcaatcgtggatttagacgggattccaagaaggcggtattatgaaatgaaggaaacagccaacatcttagagcagctggaacctttaaaagaagcatctttctgctcagaagtagggattctgctggattacgacagccattgggccttaaaaataaagccggtcaatgatcctgaattttcttatatggattttgccggaaagctgtattataatttagagcgtattgggattcattccgatgtgatttcccttgaacgtgatttccaggagtataaggcattggtgcttccggcagcttttgttctgaaaaaggagacagtaaagcgtctccgggattatgtaaatcagggcggaattttaatcgccacctttttgacgggtgttaaaaatgaggataacctggggtataccatatctcttccggcctatcttgacgaagtatttggagtaacggtgcaggaggttgagccggtattagacagcaaccggaccagactgggcatccgcctggcatctgaggaagatgaggtggaaacaagggacaaagcatggagcgagctgctggcaggggaggcaaaacttctggggtcctacaaggaaacttataagaaggactctatggtgatttcccaacattcctatggggacggaacggcttattatgtgggaacggatctggaagatccggcatggagggcactttttaagtcactgttaggccctgtctgcagacggaaggatgagatggaagctccggaaggagtacaggtgataagccggatctggcagggaaaatcaatctatttcctgtttaatttttccgggcaggagaaaactgtctgcattccggaaggaaaattggattttctgacaaaagagaagcttttacaggagataatcttagagcagaatggttttaaggtcattgtgtaaggataggcattagaaaagagaaataagggagcaccggatttaaggttcttccttatttttgcatagcaagcggagaggggaattatgaagcagtggaaattatggtttgaggaaatgtggaaaaagagaagcatcaagaatcagatcttgatttctacgctgatatgcttaattctggcagtggctttggttggctgcataacctttattttttcaaaaaggaccatggagcgcaattaccagaattcccacaggcacaatttagaagtgtccggaagcatcattgacattcagctgcagaatctggtcgacctttccaggaccctgcttaacaatcagaattttaaaaagatcatgacgaagaaacaaaagaaaagcacttatttttccagccttgatgatgttgttttaaatcatacgctgcgagatttggctgagcagaacaaatatatccagagtactgttgtcattcataaaaagggaaatatctatttttacagcaagctgaccctgcagaacggtaaaatgcttaagtatcataaggatgaagatattttagctatggactgggttggggttgcggaccgggaaatggggaaagaggtattttacgggtacaacgtgctgtttgatgataacaatgaaacattttccatggtgaaaaccttgaaaaatacggaaaatggagaagacatggggtatgtggtctttaatattaaaaaaagcatgttcctttccgcgtttggaaaaggggatgagggatatgtgaccaaccggtatatgatttttgataaaaatgagagccggtctgtaagcagacctgactggaatctcgtctacttccacggaggaacggacgtgaagcaggaggttctggaggattatatttcaggagagacgggcaagtacttattcagtgaagtgcacaatgaaaagggtgactgggaagtggtcaatgtaattgccagagaggaattaagccgtgacagcaattatattgcctggatttctgtgctggtatgtatggccatgctgatgatctgctgcttgtttgtcaacggaatttccaaggtcatcacattccctctggaacagctgaaaaagaatattgacgtggtcagcaaaggaacattccgcattgaagaggagtttgacgaaacggaaataggaaagatcggcacccagtttaagaacacggtaaacaataatctggacttacatgagaagctcctccattctgaaatcaaggaaaaggaggcggagcttttacttctccagtcgcagatcaaccctcattttttgtacaacaccctggattccctttattttatggcggtcatagagcatgcggatgagattgcagatatggtgcttgctctttcggatacgtttaagctgagcttaaacagaggagaaaagctgattgaggtgggagccgagattgagaaaataaaagcgtatatgaagcttcagaacatgcgttaccacaaccgttttgaactgaagattgagatagaagaatccctgatcacccggaaaatccttacgtttattttgcagcctgtagtggaaaatgcggtgtatcacgggctggagccgaagcttggcggtgggtgcagcatccgcttatccggctgccttgacggggaagctatggtatttaaaatcaaggataatggggtgggaattgtggatatgaaccttctggacgaaggctacggagtaaagaatataagggagaggctgtccttgttctatggggatcaggcaggtatctgttttgaaagtgaggccggagcgggaacggaggttaccctaagagtaccgcttcatgcagaaaataagggggaataacagatgtatcgaatggtggttgcagatgatgaatatatcgtggttgaggggatcaaagcgattctggaacggcagaagctgcagtgcgaagtggtgggatatgcctacaatggaatcgacgctcttgacgttatacaggagcagaagccggacattgtcattacagatatcaggatgcccgggttggacgggctttccctgatcgaaagctgcaaggaatttctgccggaagccagttatgtggtgatcagcggttatacggaatttgaatatgccaggcgggccattaccctgggcgtggtgaattatattgataagccggttaccatacagaaaattgaggaagtgctgcaggaagtggaaaaacggagcaatccgccccaatacgcatataaccggatcatacgtgagacagaccgtgttgtggatatggtgcttattggaaaagcggaagggctggaagaaggaatggaaggaatcttacgggtgatgagggaaacagtccctgattttgagcagtataaacaggagatatataagatcatgtcaatgctggtccagatttttaaggaaacaaacccggatgctgtctgtcagcttacccatcatgatgtggaaaaactccatgaggaggaagaatgcaggctgtactgcctgtccctcatccgaaagatgagcgagctttttcttggaaaaaaggtgggaagcaatcaccgtgtcattcagaagcttctgcagtttattgatgagaaatatgcggataacatcggcttaaatgagctggccatgctggtaaacatgaatccggcttatttaagcattttattccgcaatgaagtgggcatgagctatgttaaatatttaacggatttgaggattaaaaaggcaaaagagcttttggatgagggcatgaaggtaatggaagtcagtgaaaaggtggggtattataattaccggtatttttgtgagatattcaagaaatatcagggtataacgccgaacgaatataagggacataccagaagaagagattaaatacacaataagaaaattgcaaatcataattattatataaaaagtgtacaaaaacaaagaaatgactgactagtatgtggggaaattccttgttaaaatgtatctatcaaacaaaaactatgaaacgtgtgggaggtagaaaatgaagagaaaagttttagcaggaatcctggctgcagccatgatgacaaccttattgaccggctgcggaaacaaacaggcatccgatggcggcggacagacagggcagaaacggaatccgcagcaaaaacggaagcctctggggaaacagaacctgctgcaggggcggattcaggaaaacccagcgcagcggaggaccccaagcttacaaagaacatgaaaattttatcgatctgggcggaagacaatgataacggcgtgctgatcaaggctctctgtgagaaataccagaaagaggtgaatcctaatttcacatgggattatgaagtggtgtcttccgataacttaagacagaaggtggctaccctggtggcttccaatgatctgccggatatgttcgtgtacgaatcaggcaaacccattgtggacttaatcgaagcaggaaagctggtaaatgtttcaaaggtgctgaaagattttaactgtgaagaagcattgaacccatcagcagtctctcttttgaaaagtttatcaggaacggacgatatttatgatctgcctcttggaatgaatgtggaaggtttctggtataacaaggctttgtttgagcaggcaggctgccaggttccgaaaacatgggatgagttcgaatctgtgcttgcaaagctgaagggagcgggaattcagccgatcgcgtgcggtgctgcggataaatggggagcgacccgtcttttaaattcttatctcgtcagaattgccggacctgatgccatggcaaaagcagatgaaggaatttccaaatatacggatgaggattacgtgaaggccgcccagaaaatgcaggattgggcaaatgcagggtatttcggtgaaggagtcaataccgtagacatgaacaccgcgggctccatgctcatgaccggacaggcagccgtattctataacggttcatggtttacaagcaacttaaatgatgcttcccagaatctggctggagaagacggaatcggattcttcaacgtgccggttgtagatccttatgtcagcgacgaaagcagttattccatgaactgcggcaatatcctttccttcagccagaagaattatgatgaggcaaccggatggtttatgaaatatttcgcagaaaatatgggcgatctggccatggagctgcaggggagcgtaaagggctataattatacagtctctgcagaaggcgccagtggttatacacaaatggtccttgataccatcaacaatgcggaaagtgcttttacatggtttgaagcaaccatgggcaatgaagttcagaatgtggcaaaagacggaatccagaccttgttaaccggtgaattatcggcagaggattacatgaagtccattcaggaagcctgggatatgagccagtagtaagaatttaacttctataagtctgatggcctgataagccgtaaaatgagatgcggggtgctgcgaagttctgaaaaggaatccagcaccccgttttttaaccgaatcaagaaagtcccccgcttcaaatgcgaaaagcattaagcggtgggtgaggggacttgcttgtatcaggtggagtacaagctccacctgataagcagcgatagctgctattcggttatgcccgatggagcggggcacactgtgagcaagtagcgaagcggattgcgaatatccgcttgacccgaatccggcagcaaagcggattatataagtccgcctggcatgcgggagcgtcaaaaggaaagggattggaggtttttctatgaaaaaggtattggaaaataaaatggcaattgcaattttcgtattacctgcattgatcgtctattctgtcatagtcattctgccggtaatatggtctttgtattactcgttttattctggatctccggggctgaaatgggtgttctgcgggtttgacaactttctgcgtctgctgggagacagcaactttaaagcgtcattagccgtaaatttgaagtacatatccattgttatgcttggtcaggtagggatggggcttttgttggctctgatgttttatttctggctgaaacgttttaagaacgtgatccgtactctggtattttttccggtggtgctgcccactgtggcagtgggtcagctgttccagaaaatttacgagatacagccaaattacggactgctaaacagccttttagataccctgggactgtccggtctggtacagccctggatcggccaggcttccacggctctgggaagcttgtgcgtaatggatatctgggtggccatgggattttatgccgttatcttctacggggcgcttttggatattccgggagacgtaatcgaagctgcaaaaattgacggagctggcggactgcagctgtttcgccatattctggcccctttgctgcatgcaatgatcatcacctgcctgatcttcagtttttccggaacagtgaaaatgtttgaatccgcgaccgctcttacgaacggaggaccgggagctgccacgagatccctgtccatgtatatgtataatgtttccttcacctataacaaggtgggatacggaagtgtggttgcgctgttcatattcatgctgtgcgtgcttggatcgtccatcatccgtaagtttgatgtaaaagaataggaggtaggccgagaatgaaaaaaggatttaagtcaattgcaattaaattagtcattatttgtcttgtggtgatcgaagtatatccgctgttctggatgctgaccgcttccttaaaacagcagagtgagtggaccagcaagccggcatatgcgttaaactcgggcttctatatccagaattacatagaggcgtggacaagaggaaatatggatattttctttaaaaacagctttatatgtacggtggtttccttattctttattgtactgtttacggtaactgtcagttttgcggtaacaaagatgagatggaagcttaaggggtttgttggaaagtactttgaatttggcatcatgattccggtggcaactgccctgattcccttattccagatctattccggaatgggccttttaaacagcaggctctgcctgatcatcacatacacggctttcggcctgtctctgtcgacactgctgacaaccggttatctccggtcgtttcccgatgagattatggaagcggcggtgattgacggatgcggaatctacaaattgatgtggtatgtggttgtgccgctgatgaagaatgccattgttacggttttagtattgcaattcttctttaaatggaatgatctgattttttccatgacatttatcagcgaccaaaagctgaagacggttcaaaccggtcttctgtattttcagaatgaatttggagcgaaaaactggggagcgatttttgcttccgtgtctatgtgcgtgatccctatgctggtcttatatatgattctgaacaaaagggtaatcgaagggatgacagcaggagcggtgaaaggataagcgggatgatggatcaggaaagcaaacgttatgcgcaggagataaaagattatgtggcaggtcatgtgaacgggcttttaaaagagcctcatggatttatccgccatccctttattgatccgggcagtgtctatgacggaaatttatgggactgggatacctactggtcggtttacggattattcggtatcatggattctttttcagaggagctgcaggaaaagattctggtccatgccagaggaaatgtgagaaattttatggatcatcagctgaaggatggctatattcccatgatgattgaggttgaccggtggccggagccctatttaaacatgaagcataaggaaggcgtgcaaatgaacatgcataagccgtttctttgccagcagatgcgtctgatcagtgaattccaggggattattcctggacaggggagtatttagacggactgaaagcatactttgactgctattaccgaaattattttatggaagaaaaagggctgtttgtctggtgcgatgacattatgatagggatggacaatgatcccgcttccttcgggcgtcccaagttttccacggcaaatatatatttgaattcatttatggttttggaaatgcaggcatacgggtgtgttctgaaaaacgcaggaaaaagcggtgaggcccttgagtgggagaaccgggcgaaagtcctgatacagaccatacaggaggagtgctgggataaaagggatcagttcttctattctgttgacgtggatatcaggaccagaaaatttgactggttccatgaaggccttggggtgttctggaagacccttcccattaaaataagggtatggtccggatttatccccatgtatgctggttttgcaacaaaggaacaggcaaagagtctggtcagccattatcatgatgagaatacatttcacagcagttttggaatcgccaccttggccaaggatgagaagatgtttaatcttgaagcgaccaataatccctccaactggcttggtcctgtgtggctggtagccaattatgtggtgtttcaggccatgctcacttatggataccgggaagaagcagaagaaatctgccgtaattctttaaagcttctgggcatggatctggaaaaaacgggatgtatgcatgaatattacaatcctatcaacggagatccggtggtaaacggcgggtttataaactggaacctcctggcgattaacatgttggctgacttggaaaaggagaaagagcatgaataagaaaccctgggagagaggacttctgcgggtgcatgaaaacaaacggtattttaccaacggggccacgccttttttctggctggccgataccgcctggctcatgtttcaacggctgaccttagaggagacataccggtatttgagaaaccggaaggaaaaaggatacaatgtgattttagctgactttttgcatacggctgaccaaaggaatctggcgggagatgcggctctgatgaatggggacttctccaaaatcaacacctgcggaaccttttggagtcatattgaccgggtaatggaaatggcagaagagctgggattatatctgggagttctgccggtatggggaagcgatattgtaaaaaacggctccttacatatggggaatttaacgagcttcatgaaattcgtgctggaacgttatcaccactgccccaatttaatctggatcgtgggcggtgatgtgagaggcgatgttaatcaggagcttttttgtaccatgggaaaaatgatgaaagaagatgagccggaccgcctggttacttatcatcccttcgggagaacggattcctcccaatggttccacaaagaaacgtggctggattttaatctgttccagtcagggcacagaagatatgaccaggatcagttaggatcttgggatgacaaccggccctcagaaacctgttttggggaagactgctggcgttatgtggaagacgattatgccagactgcctgtgaaacctgttctggacggtgagccttcttatgaatggattctgcagggacttcatgataagacccagccctattggcaggctgcagatgtcagacgttatgcctactgggacgtgtttgccggggcagcaggccatacttacggccataatgcggtgatgcagtttcaacgtgatttatcagaagacggaagctttggcgtaaactgtttatgggaagacggcctgcatcattccggaagctcacaaatgaagcatttaaaagatttgatggagtcggtcggcttcgtacacggaaaaccggcgcagcagcagctcctgtcccaacagggagaaaagtacggtcggatcagtgtgtttgccggagaagactttttaatggcttattcttatactggaagggaaataaagctttccctggaagattataaggaaaaacggatgatggtattctggttttgtccggcgacaggaataaagagctatattaagaccgtcagggggcagtctgaaattacggaaacgccgcctgccgtggatgagacaaaggatattgtgctgctgttgcaggaagaaaaagatatgcatggagaagtagacggatggaaaaaagaataagcagtgagatattacattcatacccctgttacgataagaggaaggtggatgatctgctggcagcagaagccgacgcggataccaggaaaattgttgttttggatgatgatcccacagggatacaaacagtccatgatatatccgtttacacggactggtctccggaaagcataggccgcggttttgaagaaaagaataaattatttttcattctgaccaattcaaggggatttacggcagaacagacggctaaggcccatggggaaattggaaagcgggtagaccggacggcaaaagagatgggaatggaatatctgattgtaagccgcggggattccactctgcgcggtcattatccattggagaccgaagtgttaaaggcggttttagaagagcagaacccgtggaaggtggacggagaaattttgtgccccttttttgcagaaggaggacgctttaccattgataatgtccattatgttaaatatggggccgaactggttccggcgggagagacggaatttgccggggataagacgtttggatatcaatcctccgacctctgcggatatatcgaagagaagacggagggaaggtttcgggcggattccgttgtctgcatttctttggaagatttaagggaaatgaaacttgataaaattacagagcagctgctggctgtaaagggttttcagaaaatcatcgtaaatgcggtagatgaatatgacattaaggttttctgcattgctctttaccgggccatgggaaggggaaagcattacatcttccgtacggctgcggcttttgtaaaggcgtttggcaatatcagtgacaagccccttcttacgaaagatgagatgataactggggccggaagggcggcagggattgtggtgattggctctcatacggagaaaaccaccatgcagcttgaagagttaaaaaagacggctggccttcagtttattgaaatggattctgatctggtgctgacggctggagggctggaacaggaggcaaaccggatacggacgatgtgtgaaaatgcggtccgtgaagggagaaccgtagtcgtttatacaaagcgccgtctgctttccatagaaaatgatacaaaggaagctgcgctgcttcgttcgttaaagatatcggaagcggtaatgtccctgattgagaagctggaagtgacaccggcatttatcattgcaaaaggcggaattacttccagtgacattggaaccaaagctctccgggtgaaatgtgcccgggttctggggcagatccgtccgggagttccggtatggcgtataggagatgagagcaagtttccccaactgccatatgttatttttccggggaatgtgggagatgtgactacactccgggaggcggtggagctgttaatgatataataatagaaaggattcaatatgaaaattggtttgatttataccagcaccacaccggagctggttgaaattgttgaaaaagaagtcagggaacagctgggcagccaagcggagctcataagctttcaggatcccacaattctggcggaagtgagaaaagaaggttatgttacagcagcgcctgcagcaaggctgatagggatgtatatgaaggcggtggagcagggagcggatgcgattctgaacctgtgctcttccgtgggcgaggttgcagactgcgtgcaggatgcagccagatatctgggagtgcccattgtgagagtggatgaagagatgtgcagggaagcggtcagactgggcaggaacatcgcagtgatggcaacactttctaccacactggagcctaccaaaagaactgttttacaggtcgcaagagagatgggaaagcatgtggagatgatggaggtgctggtggatggagcgtttggcctggatcaggagcagtttaaggtcttgatggcagagcatgccggaaaagcagcgaaagaggcggatgtgatcctgtttgcccagggctctatggcgtattgtgaaagctatatcgctgacatgtatgggaaaaccgtgctttccagcccgaaatttggagcaaaggcactgaaggcggcccttatttcaaagggaaccttatgaccaatgccccttacaaccaatgaccctataacaaagaaacaggagagctgtatgaaaaaaatagtgatatccgttgcaccggtggcagcagatgatacgttgatcgatcccaggaagatcgcagaggatgtcattgcctgcagcagggcaggagccggaatggtgcatctgcatgtaagggatgggaatggacggctgactccggatttaactctgttggaggaaacggtccggtatattcgttcggaatgcgacattgtcatccaggtatccacgggaggggtatcggatttaaccataaaggagcgctgcacacctgtatttgcggactgggtggaagcgaactccctgaatgtaggctctgtgaatttgggagatcaggtttatatcaatcctattaaagatgttcattattgcgtagagcagattcttaatcatcataaaactccggagatagaagtttttgagatcggtatgattaaaacggcaaaggatttgtccatgaagtatgaatttacagacccaattctgttcagcattgtactgggacatatgggagcagctccggccacggtccgtaccttaaagtccatgctggaagcattggaggaattctttccggagaaagagaagatcctgtggggaattacccatgcccatcggaccgatttccagattataaaaactgcgctcgatttaggggcctccacggtgcggatcggatttgaagacagcaggtatttaagccgggaagccatagccggtacgaatcttcagttagtggaggcggcggcaggcattgtgagagagaagaaaatgctgcctgcttcccctgatgaaatcagggctatgctgaatattcgtcccctataactacatgtattccgctcttatacgttcaacaaaggcatatcaacctttgacatctttcaggctggatggacttctaattatagtataagtaaaaagaatgaaacataatttgagtaatgccccttgagcgtaagagcgattttgcttttgcgcttttttcttagagaaacaatactattgattttaaggtgaaaatatataaattattatcttaagatataagtacatgttgaaaaatagcaggaagggatatacaattatagtaataacattgttggtattgctattgtctttttagaggttaaaatttctgaatattatcttacggcttcaagccggcagatacttggaaattagtttcctcttttgccagggccccacgggaatatgaacgagttattttaacaattcaaagcaagtggaggcttgtagcaaatttaacgaaaataaatggattgtaatttatcaaacggaagatatggagggatctgtttgaaaagtctgatcagattaacggatttaaagtcaagggagatatatgatattttcaggatttcagatgaaattcagtgcggtaaatacattgatatactaaaagggaaaagtgtagtcttattcttcccaagttcaagtattagaacgcgtgtcacatttgaaaaggggatacatttattaggaggacaacctatattatttcccaatgaagcgcttgataaaaaagaagatttgagagatgtatgcgggtatttaaataactgggcagatgttattgtagtaagacataggaatatacacatactggaacagctggccaaatatttaagagcaccagttataaatgcaatgacagatgtaaaccatccatgcgagatactcacagatatgtacgcactttcaaagataaggaaagattttattcatgataaatacttattttgcggagcgttaggaaatatagggttggcttggaaagaggcttctgatgccatgggctttgaattatcacaatgttgtggtaacggctatgagataaatggtttgatgacgtacaactacgtaacagaagccataagcggcaaagacattatttgtacggattcattgccttcaaatgtacttgaggattttagaaattgtcagattacaaaggaaataatggatatggcgaatgatggagcgatattaaatccctgtcctccattttatcgcggagaggaagtttctgatgatgtgatagagtcaaagtactttgttgggtacgaatttaaaaagtatttgcttcaagttcagcaagggataattatatactgtttgctcagctgaattctgatttgtgaaggagttgtttattataacgaaaaaaggaaggatgagttttggcttatcgggagattgggcagagtgaagtaatggaagtttagtatagattattttttaaggaggtatcagcattatgaatgatgaattaaaaatcaaaatgtactcgtttacggtggattgcaaagacccgcatgaattagcaaaattttatgcatcgctgcttaagtgggaaatgatgttgatcgatgaagaatgggcatgtgtatacgctccgggaaccaatcagggaacatatcctggtataatgtttcaacggaatcctgagtataaaccgcctgtgtggccggaagagcctgaaacgcaacagcaaatggcacatatagacttcgctgttaatgatttagaaaaagcggttcaacatgcagtccattgtggagcaacaattgcagatgagcaattttctaatgattggagagttatgtttgaccccgccggacatcctttttgcttatgccaaatgaaatcaatgattgagagtcctcattttgcgttgttatagataatcttgatatactcattacaagcggatcgtattaacattatatgaggcttggcagatccaatttgtaaagagaaaggatgtagagcaggagaaagtaaaaatgcaagtagaagataaaataatattcaccgtatatgaatggcatatacccgacatgtaaaataatgcggctttgatataactgaggatcaagtagaattacgtacctgccatgatatttctattgatataacattggatgacatttacgagcataaatttaaagaaaaactgggattatttaatcagtcgatatatcatttattaacgaaaatccatgagaatatctgtattgaaagaaagacggtgctgggacttgcgtccttgcaccgtctttctttacagtctgagagatttcaattagaaatctctttttttatttttgacaattctgcttccgtaagatactaataaaaaaattaatggagaaaatattacaatacatacaaaatacagaataaataaaaaagattaggggatttgaacagtataaatataaaaacgtattgcaaattgcggacaataaattacttttgatagttataaaggacaaactgcgattatgtccgaataactattttcaagaatgcttcgcaattctgattgaagaatatcggtctattaggaatccggcaggggggggttatatcaccttgcctgctggaccttttggagataaaaattttacaagaattttacctataattaacatagataatgcttttgttaactttaattattgtataattaataattgttgtgaaaaagaagatagaaatttcaaatattataaaggataagagcttcttaattaaagtttaataaggagtcggttagcgagggtgacgaatggatgatctaatgttaaaacctgggcaaagagccaagataaaaacagatgcggtaaaccttttttatggcaatttccaagctctgaggaatgttacaatggatattgcggaatgtgctattacagccataattgggccgtcgggatgcggtaaatcttctcttctgcgtctttttaatcgtatgaatgacccaataccaggagttagggtagagggggaaattatgcttgatggtgtttctatctatgataagaatatggatgttgttgtacttaaaaaaagagttggtatggtttttcaaaaacctaatccctttcccatgtcagtgtatgataatatggcttttggtccaaggcatcatggaataaaacaaagagctcgtcttgatgagattgtggagaggaacttgaaccaggtggctttatgggacgaagttaaggacaaattgaaagaatctgcttttgatctttctccgggccagcagcagcgtttatgtattgcccgtgcgttggctgtggagcctgaggttttgttaatggatgaatcttgtagtgctcttgatccggaatctacaatgcaggttgaggggttaatggaggagctggctcaaaaatatacgattattattgtaactcatagtatggagcaagcagcaagggtgtctcatatgactgcgtttatgatgatggatcctgatagggcggggacgttggttgaatacgctccaacagcacaaattttcgctaatcctaaggataaacgcacagaggactacattacaggtcggtttggataaagatttataaaaggtgaacttgcagttctttaatatattctgagaaatggaggaaatcaaacattagaattttatcgtagctgatgattttaatgtttgatttttgtgagacatatgagaaaaaagattgtaacatgcaaattattaagacggataagaggttttgtcagcgtagtgatattgaccctttccatgggtatgatgactgcctgcagccaggcgcctggctcagctgcgattgttgcaggctcaacttctgtacaaccctatgctgagattctggcggaagagtatatggttttaaatcctgacgctgtgattgatatccagggcggaggatcttcggcaggtattacggcaaccaagacacacagtgctgatattggaatgtcctcccgtgcattaaaagatgaggagaaaaatctgtggaatgtagaaattgctcaggatggattggtattaatagtgaaccctaagaatccaatacaaaaccttacttcagatcagatccgcgatatttacgcagctgcaattaccgactggagtcaattgggaggctcaaagtcaaagatcaatatcatagcgcgtgaagaaggatcaggtacaagaagtgcctttacggagctgttgatgggtgaagaagagataaccccgaaagctatcgtccaggactccaatggggcggtacggcaattggttgaggatgaccctaatgccataggatttatctctttgggtctggttacggataaagtgaaggctttgcatttagatggtatcgaagcgacacgagaaaatataatgaatggcagctacagactgtccaggcagtttttgtttgtcactaacggtgagccgaccgggttagagaagagattcatagattttaccctttcttcagaggggcaaaagttactgagcaatgaaggacttattccttcagcagagggggcagggaaatgaagagtttcaaggaaaaattatctgaacgagtgtttctactaatcgctctttcgactttatcggtgctggcgctcattactgtgtttatatttataaaaggtatccctattattgccgaggttggcataataaactttgtttttggtatgaaatgggctcccagccaaggtgcctatggcattttcccgatgatagtgggatctgtatcggtcactttaggagcagcaatcctgggagttcccattgccatttgctgcagtatttttttggctgagtttgctcctgcaaagcttagaaacatattcagacccgccatccagttgctggctgccataccttccgtggtatatgggttttggggagtattgttcgtggtaccaatgatacgtaattacctgggagggccggggttaagcatattggccggttccatcattttgggtattatgatcctgccaacgatcatcagcatcaccgaagtatctctccttgcgctgccgcgccattataaagatggagcgcttgcattagggttgacacattggcagaccatatgttcactgctgttacctgcggctaaatcgggtattgttgctgccgtaattttaggtttaggcagggcaattggtgagactatggcggtgattatggttctgggtaatgctgtcgcacttcctgaatcagttcttgaccctgtcaggacactgaccacgaatattggtattgagatgggatatgcatctggcgaacaccagcaggcgctttttgccacaggtattgtactgtttgtcattatcatgattttaaatgctactgcccaatacatcacacgaaagaggtgaggttactatgagaattaacccgaaatcttcccaaaagatagcaaaatttttaatttggacagctgctcttcttgttattgcaattcttttttctatcattattcatatattagtcaagggaatacctatgctcagctggcagtttttaacggatattccgcgggatatgggccgttccgggggtattgcctcttccattgtcggtactctgattgtgactgcagtagccgttattgttgcaacaccatttggaattggaacagctatataccttacggagtacacacgggagagcaaagtcacccgcattatccgtttcagtgccgagtccctggcaggcataccctccattgtatatggactttttggttttatcttctttgtcatatacttaaaaatgggctggtcaattttgtccggcggattaaccatggctatcatgattcttcctactattatacgtacatcagaagaggcgattcgtactgtgccgcagctataccgggaggtaggcttctctttgggactcactaagtggcaggcaataaccagaacagtacttccatcagcactccctggtatagtaaatggagtgattttgagcatagggagatgtgtagccgagacagctgccgttattttaacagccggctcagcattgcgtatgcctgcatcaatcttctccccaactcgaaccatggcagtacatttttatatactggcgagggagggaatatccatggataacgcttatggaacagcagcgctcttgattattcttattcttctgcttaatgttggttttaatatgctggtcaatcgattcatagcgaagggccgttaagaggtgaaaaatgatacagaaatcaaaaatagagataaaaggattaaacttctattatcaacaaaagcaggttattaaagaactgaacctggagatacctaaaaatcggattatggctgtttttggtccggccaacagtggtataacaacactgctccgcacattaaaccgtctgagcgacttgactgtgggtgcccgtcaggagggtgagatacttttagatgggaaaaatatctttgacccggatgttaatgtgacagaactgcgccgcagggtagggatggtttttgatgtaccaacacctcttcctatgtccatctttgataatgtggcattgggcccccgtatgggtggaataaaaaccaagtcggctgtggcagaggaagtagaaaaggctctgcggatatctgccctttgggatgacgtcaaagataggctggatactcctgcggccaggttatccggtggtcagcagcagcgcttgtgtattgccagggttttggctcttgagccggaggttattttgctggacagaccctgttcagctcttgacccaatatcaacggccaaaattgaggaatccttaatacagcttaaggagcaatacaccattatcattgcaccgcataccgttcagcaggctgggcgcattgctgaccgggttgcattcatgctaatgggagatttaatagagcaaggttatacccaagaggttttttcattcccaaaggataatcgaaccaacgattaccttaccggaagatttggttgaaattccgaatattttatatgtttttgtaaaaggagatgagcattttggttagagaacgttttacacagaagatacttgacgttaagcaaaaggtattaaaaatgggagccctggttgagaatattattgatacggcagtgactgctttaaagacacaagatcttcaacttgcaaggattgttttgaagaaagatgatgaaatagatcagttggaacttgaaattgaacaggaatgtatgatgcttcttgcccttcagcagcctctcgccaaggatttaaggacaattgcatcggttctgaaaatcataacagatcttgaaagaatgggagacaatgcagtaaacattgcagaggtaatacttgagattggcgaagaacccattatgaattccctgaaagatattccaagtatggcagatattgctcagaaaatgttaaaaatgagtcttgatgcctttgtaaatgaggatattgcccttgcagaaaaggcagcggagagggacgaagatgttgacaggctctatgaaaccgttataaatgatatccttaacattatcacagaaaaaagagaacttacaaaacaaggcactaaacttctgttcttaggccggtatcttgagagaatcgccgaccattctacaaatatatgtgaaagaaccatatacatgattacaggtgagttaaaggaaatcaattagaggcatgcctctgattgatttcctttcagacagctctgagaaactaaagcgaaaaagtatatgctaaaaaagcccatgtaaaggcagtccgtcataaaacagtataaaaaactatattgtttatggactgctgccatgtaaaatgtctaaaacgagcggattgttcaaagtggacgagccgtgaatgttgatcttttacctgtaaaagaacaagcggaaacaacgaaatagtacaatacagcgagcagaaagtattgtgaatatgagaatagactccttgtactagttttcgtataagttagctatatcttgtattctgcgcttcatttctgtgcggatatgtaacggctctaaacactggcatttgtctccaaaactgaaaagaatattgtaatagtattcgttctctatgaaaggaaaactaacaatgtaatgctcattaccgtctggagaaaagtgttcataggtgcaataatcaagtaccctgtccatgacagatttatgaatacgaattttaatttttgtttgcatagttgccaaaatatcagtaaaatctaactgcggtttttgataatctcgcggcgtaaaaaattcctcttgtatttgcaggtttgatatgcgggagagtttgaataagcgaaaatcatttcttttatggcaatacccttgccaataccaatcactacttttcaatacaagctgatacggctcggctgttcgttcagttttatttccatagcggtctgcatattcaaaggtcagcagcttgctttcctgtaaagctgttttgataatttctaaatatggttgtatgttcctgttgcccatccacggacttaaatctatatatatttgatttgcttttaattcaatgtctttcgctctgtcggcggggataaaactcttgactttcgcaagagcgtttaccagttcatcacctcgtatcatgttggaaaggctggaaagccccatcaagatagcggaaatatcggcagtcgaaaaaacttttctgtcaatcttgtatttctgcatgatttcaaagccgccgcccactcccgatgccccgcggacaggaataccagccatgttgatcgtgtctatgtcgcggtagattgtgcgggggaaacttcaaacatatctgctaactcctgtgcgcctatacgctctttaccaaggagtatcataataatgctcacaagcctgtcaactttcatttgatagccgcctttcaaaatttcttcttatcatcatagattgttgccatactgttgtcaacaattacatggtacaataaaaaggcaaacaaatcaatctacctatcaggaggagacactatgcagaaaaaagctttagtaataatcgatattcaaaatgacataacaaagaattataagaatattattgacaatatcaataaagcgattgattgggcagtcaaaaataatattcacgttatttatataaggcatgaaaatttatcggtcggtacgaggactcttaaacctaatacatatgggtctgaattagcctcagacttgaaaatagtatcaaaaaatgtttttacaaaatacaaaggcaacgcattaaccagtgaagaatttacagactttattagtaaaaatgaaatatgtgatttctacatagcaggagcagatgctgttgcctgtgttaaatcaacctgttacaacttatgcaaagcaaattatggcgttaatgtcctatcagattgcattaccagttatgataaaaggaaaattgacgaaatgctgcgttattatgaaagtaaaggcagtaaaatcattcgtttaaatgacttgttaccgaatcacatctttgaagcacagaaacattactgaactcagtcgatgaagaaggccgtctgacattggattagctctcaacggcggactataatacttcgggccgctaaagcatagcggctccggttgtcttgttcatttttgatttattgctttttattcacaaaggcttgactttgcttagctggcctggttagtggtaagccataaatgctcttaaaagtgacatgcttgaattattcgatatctcgaaatataatataagcatatctgtaaaaagacggtgcttacatggtatttttaacagtgaaagaggccgggggaaaatggcttattccagccaatatagaaaaacctaaagatggacggacaaaggagcaaaataatgaataggatgttacttcttgaagatgatttaagcctgattgatgggctttcctgtttgctaaaaagacagggttttgaattggatattgctcgaaccgttagagaagccaataccatttggacagacggtaaatacgatttattgatcctggatgtgtctctgccggacggttccgggtttgaagtatgtcaaaaagtgcgtcaggtatccaaagtgccgattatctttttaactgcgtcagatgaagaaataagtatcgtttcaggacttaatatcgggggtgacgattatataaccaaaccctttaaattaggtgttctcatatcgagaattaacgcgttgcttcggagagcaaagaactttggaacgacagatacagagataatatccaatggaataaaagttttgctgctgcaaggacaagtgtataaagacaaccggcttttggatttgacaaaagccgagtatcggctgctttgcctgcttatgcaaaatcccaatatcatattatccaaagaaaaaattctggataagctatgggacggtgagggcagctatgtggacgataatacattagcggtatatattcgcaggctaagaatgaagatagaaaacaatccgggtgaaccgcaaatgctgctgaccgtcaggggtatggggtacaaatggaatatattgaattgaggtgggcaggtgaagatttttaccaatacggatattagaaatttttttattgcaatatcgtgtatattgggcggttttatccttttatttcagttactaatatggctgttttacggcacatggaaccttgtcatactgttgctgtctttgttcgctgcattgtgtattttaggcgtttgctttctttattttcgtaagcaaaatcagattatggaagaagccatatctaaaatcaatttattcctttcagggaatacggatatccgaattgattgcgataaggaaggcagtctgtataagcttttccatgcagtcaacacattggctacagtactcaatgctcatacagtaaaagaacagaaactaaaagagtttttgaaaggtaatatttctgatatttctcatcagctaaaaacaccccttgccgctctcacgatttacaacagtctgttacaagatgaaacagaagatattgccgcggtaaaggaatttgcagtaaaatcagagaaagagattgagcggattgaaatgcttgttcaaagcctcttgaaaatcacgaagctggacgcaggggctattattataaaaaaagcacctgaaagtgtagaaaatatgataaatgatatctatcagcattttgaatttcgtgccaaaggggaaaagaaaattattaccttgtcagggccagatgacacccggcttttttgtgacagagattggatcatagaagctattagtaacattgtaaaaaatgcactcgaccatacgaacgcaggaagtcagattacaattgagtggaaaaaactcccgtctgtcacacagataaccataaaggataatggaagcggcatacaccctgaagatatacaccatatttttaagcggttttaccgcagccgcttttcaaaggatacgcaaggaattggccttggactgcctcttgcaaaaacaatcgtggaagcacatgacggtaccatcacagtggacagtgtattaggtaaaggaagcatatttgttatgaattttcttaaccttactaagatgtaagcggaaattcatgtgggagtaaggtgcagatgttagcgtatccttaggcagttataaaaacgtaatgaatcgtaactgcctggaaaggtgtaataagatatggatttattagaagtgagaacaattagcaaaacctatggtacaggtgaagctgcggtcaatgcactaaagaatgtgagcttttcgattcctaaaggagaatttgctgccattataggggaatccggctccggaaaaagcacattgcttaacatgatcggtgcactggacactcctgcttccggcaaggtgttaattgacggcaatgatatattcagcatgaaagatgaaaagcttactatctttcgccgcagaaacattggttttgtttttcaggcgtttaatctgataccggaacttaatgtggagcagaacattacatttcccgttctgctggactataaaaagccggatcaggcttatgtagaggaaattctagctgtgttgtccttgaaggacaggcggaatcacctgccacggcagttatccggcggtcagcagcagagggtagccataggacgtgctttgattacccgtcctatgctgattcttgcagatgaaccgaccggaaatctggacagccaaaacagcagtgaggttatatcgcttttaaaaacagcgtctaaacgctatcagcagacaattatcatgattactcataaccggagcattgcttctgcggctgaccgtgtgctgcaagtgtcggacggtgttctcacagatctagggggatatacccaatgaacagctatcttggtcttgtttcagaatatgcaaaagtacataaaaagaaaaataggctgactgtaatatgtattgccatatccgtcatgctggtaacagctattttcggtatggccgatatgagcctgaaatcccaaattaatgaatcgatacgccggtatggtaactggcacgctattgtttcagatatttcagacgatacagcagcctccatagacagtcgcggtgatatcaatgtatccggttttttgggtatggctgatgcgataacatatcagggaaaggaacttattgttcagagcagcagcgaagagcttgcgaaacaaatgaatttggttgtttctgatggacgttatcctgaatcggagcaagaagccttgcttgacagtcagggtcttgaacagtttggtctttccattggtgacacaattgaaattgatttttctgacggaaaggcaaggcagtataaaatcactggaatctacggtgatttctctagcctgcaaggtacggacgctcacggtttacagctgtcaactgctggaatgcgtacgcttccgtctgaactatatcaagagtatgattacattcaattcaaaaacggtgtaaatatcaatcaggcgctttcggaaatcaaagcggaatatggtctgactgataaacaggtttccacaaatgccatgctacttggcctaatgggacagagcaatgacaccactgtgttagaagtttatcttacagctgcaattttatttattcttgtgacaatgacaggtacattcatgattgccagcagctttagcatgagcattttggaaaggacacaatttttcggattgctgcgctgtcttggagcaaccaaaaagcaaatcaaacgatatatccgacttgagggacttcagtattgtataaaaggaatacctatcggattattggccggatgtgttatattgtggacagcactcttttttttaaacaggctgaactcggaatatcttcctgaaatgccaatgttccagatcagctggattggtatggcttcgggaattataatgggcttcctggttgttttgcttgcttcaaaatctcccacaaaaaaagccgccagggtatctcctcaagctgctgtaacgggcaatatcaataaaaccaataatttgcaaataaacagagcgtcaaacacaagaatgcttcacgtagataccgcaatgggtgttcgccacgctttttccaataaaaagagcatggtgttgattgcgggttcttttgcaatcagcatagtcctgttcttgtgcttttcaatcttaattacctttatgaaccatgcgttaaatccgttgaagccttatgcgcctgatttatccatcgagggaacccaggataccgttctgcttaaacgttcactcaaagaagaaataaatgcacttcctcatatagagaatatctatggacgtatgttttacacagacattcctgcaagcgacaaacgggataccaatacggccacactggtttcctatgacgagcctcaatttgcgtgggcagaagattcgcttattaccggcagtattgaaaatgttaaaaacggaaacggtgtattggttgattacgggtattcacaggaatttaattggcagattggcgatacgattacgctgaacatgaacggaaagctgcatgaggtacaggttgccggtattgtttccgatgttccccttgattcagctaatggcgagtggattattctttgctcagaaaacacatttacagccttaaccggggtagattgttataaaattattgatatacaggttaagcaggacatttccggtcaggtcagaagtctgattacaccggaaatgaaactgctggattttcagcaacataacagcgaggtacgcacaagttatctcgcaatggcagtatttgtatatggatttttgatggtcattgcactcgttgccttaatcaatattatcaacacggtaaacgcaagtgtttccagtcgtattggcaactatggcatgatgcgtgcagtgggcatgtcaggtaaacagcttaaaaaaatggtaacggctgaggctgctgcttacgctatatccggcagcctgacgggaggaattttaggactaattttacaccgtttcttcttcggaatgttgataacatccaattggggagagctttggcagccgccgcttgtggttttgactgctgtcattttagccgcgatcctaacaacctttatcgcggtgatttcaccaactaagaagatcgaaaaaatgagcattgttaatattatgaatgcaggataacagtaaagtgtatttaggcagccggaacacggaaataaaaaaacgttgtttcggcggtggtatagctatgccttttaaagaacagccatgccaaacaacggtggcattgggagatgctgatgatgtttataattaggttattgacatatgccaaaaacagagtataattattatataaatggcatatgccatttatataattgacttggaaaggcggtaactatatgccaagacctcacaaatgcaggcgggtatgctgtatgcctcagagcaaggttttcggtccgctggatactccggaattaagtgaacaggcaatcagcatggctattgatgaatttgaggcaatcagacttatcgatctggaagggctgacacaggaagaatgcgccgggcggatgggggttgccagaacaacggcacaggcaatctataacagtgcccgtgtcaaattagcggagtgtcttgtgacgggaaagaagctgtacctggaaggcggtaattatgtcctttgcaatgaccgcacatctcattgcggctgcagacattgccatagggaacagcatccggaaagaacggctgcgggagagaaggacattcagtcccatacctgtgatgaacaatcagaatgagacttccggacacgagtcagtttgaacaatggagtgaatagattacaggagggttataatcatgatcattgcagtaccttatgagaacaaacaggtgtttcaacattttgggaaaacggaaaccttcaaaatttatgaagtaagtgatggcagaattaccgctgcagaaatcctttctgcagatggccgcggacatggtgaactcattgacattcttaaaaagcgaaaggtttccgtgctgatctgcgggggcattggcagcggcgcccaaaatttgttgatcgaaaatggcatacaattctttggcggagtaattggtgaggcggataaggctgtagaggattatctacaggaaaagctgaattacgattccaatgttacatgtggtcatcaccatgaggagggtcatatttgtgagggacacgaccatggctgtgagcctcactgaatcaatgacaaacaggagtatgggaacgaatatgaataataaactggagaatccaaacagacttgcggaactgaccccaaaggacacactcagacgaatcggcctcaaagacggagatactttctgtgatgttggagccggtacgggaatatttacattcgctgctgctgaaataacaaataataaaatatatgcagtggagatttccaacgaaatgctggaggtattgcgggtaagaacagaagaaaagaagcttgaaaatgtcatgatcataaacggcattcaagcaatgccggaatcatcctgcagtgttattttgctttgtaccgttttacatgaagtgcctgatgtgcagaaaatggtaaatgaaataaagaggataatcaccaaaggcggagtgttgtctgttatagagtttcataaacggcaaacgcccatggggccttcagttgagcatcgcttggatcgtatacagctggcggaagaccttcgtaactatggattacatcagttacagcattttgagctgggagagaatttttactgttctgttttcagatgcatggattaatgatatttttgtaaggttgggttcaaaaattcattgcctttttatgcagaaccaaacacaagagactatgttttctttaatgagaaatatagtcttttttattgctgtttaagagatatcgtgataaatggcaaatggaatggctgggatcaacgtgctctgtctcctttgtctgcagtctgaagctggtaaacaaatgttttactggctttttttgttcatcccaggcattcatatgtttatttaacaaaaacctgcgtgctttttttatattatttttgcatcagacgccatagggttgtgcggctgatgcccaaacgtttggctgctgaggtgtggttgcccccggtttcattgaccacccggatagcgatgtcctgactgatctctgtaagcgtacggtttaaatccagaggagtggcggcattttctttctgggaggagaaagcaccaacgtgccgttccttaagcagtacctgacggacattttcggcggtgatgatttggcctgtacccgttaccgcaagttccccaattacccggcggaattgggtgtaattatggggccagttgtaactttgcagcagagacagcgcttccgggtctgcacccagaatctgccggggcatgttgacgttcatgtggctcagacatagattcatcaaagtgggaatctgatgagagagctggcgcaacgggggtaagtacaaggaaagacaggaaagtttttcccggaaaagggcacctactttggatatatattcaccgttctgacaaacacaggaaatcattaccctgtttcgccggcacacatccatctctgtcagaacagcgattagctggtactgccgttccagagataatacatccacatttgaaaagtatagggtgctgtcctcgtctgccaatggggagttgtgatgctccataagaaacacccagctgcggtcgttcagcaggctgcagttgatggatactaaggggttattccgcagcgggcccctgatgtaaagcatgctgacgacagattccttacctgtgccatcctcgcctgtgaagatgacaggggcggtactttggcctatttggtcaatttcctgctgaaagccctggagatttcccgcaaagctgaaaatgctgttgtaataagctgcctctgcctctgcccggccggagaaactgattcccatctggtttgaggatacggtcaattttctttcatcgaagaaaaaagcggtatatctcaaagtaccgctggcaatttgccggacacgaatggagtagcgcatgcctctcagagaacggctgatccgctgatccccctcctgctgtccttgggatagttcctggcgcagcaattccaataattcaggctttggatcttccagcgtggacagaaacagatttccctgactgtcaaagacaatcgtctgcccgatctgccctcggataagctcccgaaaaaacaagttttcatcccgcaggtattgttggctttcgcacagcagcaatacctggttataggcatttcggatgctgtccattccggaggtgataaggaaagaattgattcccagccgctgtgccgtggtgttaacaatcacgtcgcagagaatggtctcacactgtttctcctgaaggctgcgcagagtcggctccactgcctcaatagaatccactgtatggatatcaatgtcgcattccagcaagtcgcataagggcagcacatggtttcggatatcagcgaaagaaatcatggtaatcttttttttcagtccgttggccaatttgatggcacagagaatatcatacatagaaatttcgatctcaataaccggaatggttagctgccgccgcagcatctgcgccgttgcaccacgggaaattaccacatcgtaatctccatgaaagttattctgggcgataataaggccctgctccatatcaccaacatagactgtcaaatcaatctggggatattctttcgccagattgagcatctgaattttcattccctcatagggcgcaatgcccaaaacacgaatatagtttttcataaacacctccatattgcgtttcatatttgaacatattataccaaatgcacaaaaaataagcaataaattttttgtatgtttcaaatataaacgatttaaagccgaaaataacttgacgaaagcaataaaatttatataaaatgaatataaaattaaactaaaagggattgacaatttccaaaatgcacaaaaaagaaattagcccttctatactgtttcaaaatgaaacaacaggaggtaaatgtatggtaaagcttctgatcattgctgatgacttcacaggagcacttgacacaggagtgcagtttgcagccaggggcacagcaacaatcgtggtcacagatttaaactatgatttccgaacaattgaaaaagcggtagaagttttagtggtggtggcagaaacccggcatctgcagccacgggaggcctatgagattgtgtacagcatagtacatagagcatttcaagccggaattgcttacatttataaaaagacagactctgtactgcggggaaatattggcagtgaattgacggcactgatggacgcaacaggtgtcagcgccataccgtttctcccagcctttcccaaactgggcagggtcacccgtaagggaattcactatatcgacggtgtacctgtggcccagaccgtttttggccaggatccttttgaaccgattttggactcggcggtggcggaaatccttggacagcaaacgaatgtgccggttctgatacatccacaaaataaagagtatcagatttcaaatcccggaatccaggtatttgatgctgagacagatgcagatttaaagcacatcggcagaaaactggggctggagaggctgcgattctgtgcaggatgtgccgggtttgcggcggtgctggcagatatgctgaatttgaatgggcctgcctccaaaatgcccaagcttgaagatacactgtttatagcttgcggcagtgttaatccggtaacgatcagccaaatgaaagcggcagaagaatacggctttccccatgtgaatttgaaccctgttcaaaaactggaaggcggctgggcggatagtgagccggcggccgaatgtgttggtcaatggctggcacaggcatatgcgaaaaaacgctttattcttgatgttaatgacccggaagggtatgaggatacccgtatctatgcacaggaacacaacctgacaacggaacagcttcgggtgcaaatttcggacaatctggcagctttgattaagcgaatgcttgaccacggtctgaacgccactcttttgtgcaccggcggagacacgctcatggcgttaatgcaggcgttagatgtttcagagctgacgccaatttgcgaaatggcaaccggcgttgttttaacagaatttatttacaaagaaaaaacatatcatattatttcaaaatccggtggttttggatatcaggatctactgataaaattagcagaaaaaatttcctggaaataaaaaatatgaactggaggtatatattatgagctatcctactcttgccggtctgactttagacggtcgtatttaccgcaacgaagaaatgggtactgtggaatccatggtacctcccggcccttttgctacctgtcattctcctgcaatgctggagcttccaaacggtgacatgctgtgctgctggtttgcgggaacctatgaaggagaagccgacgtgcatattgtatgtgcccgtcttcccaagggggccgatcgatggaggccgccggtctccgtatccggtgatcccaagcgcagcgagcagaatccatctttattctacggtcctgacggtgctgtctggtgtatgtacaccgcgcagctggaccgcgttgcgggcaaagataacatgcagttcacttctcaaatcagatgccaaaagagctttgacggcggcctgacctggggcggctatgagaccgttttcccaagagaaggcagcttctgccgccagcccattcagattctgaaaaatggccgctggatttttggcaactggctgtgcacagactccgaagaaggcctgtccggcgaccccagtgtatttcagatatctgatgaccagggtaagtcctggcgaatggtagaaatgccgaacagccgtggccgtgttcatcctaccgttgtggagcttgatgacgggcaccttgcggctttcatgcgcagccgtgaggccgaccacgtctaccgcagcgaatctctggactggggcgaaacctggtcagagccgaaacctactcctttgccaaataataactcctctataagtgcgatccgtacccaaagcggccgtgttgctgtggcatataaccccaccgccacgccatctcccgttccgggcaaagctgcatggccggggctgcgttgtcctgttgctgtggcactgtccgaagacggcggccttactttcccgttaatccgcttgatggaacgtggagagggatacatgggtgaggagaacaaaacaaacaacaagcaatacgagtacccttacctgatgcagagcgctgatggcagactgcatttgacatacgcagcctacacccgtaagtgcattaaatacgtcagcttcaccgaaaaagacgtgatcggcgcaaagcgtgagtacgtcggcgtgtacaaccctacatccggcgagggcacaaaataaacaacattataaggatgtctttcactaaattacgatcaataggagtgatatcagatgcagactgtatataatttaagaatgccccatgccgtctacggcggcgaaaactcaatagacaatatcactgcaatattaaagaataattacgttaagcgtgtagccatgtttaccgacaagggaatacatgcttccggcctgtttgatttgccggaagctgcagtaaaggccgggggagcagattactatgtgctggacgggattccgccggagccatcctacatggcggtgcagaatattgttgatcaatttaaagcaagcggcgcagatatgattatcgcctgcggcggcggcagtgttttggatgctgccaagctggccagcgtacttgtaactgatgaatacggtgtaaaggaactgctggatgagccggggcgcgcgaaaaagtgtgttccgacaattcttattcccaccaccgccggcaccggtgcggaggtaactccaaatgccattgttgcggttccggaaaaagagctgaaagttggcatagtaaatgaaaatatgattgctgattatgtaattttagatgcccgcatgattaaaaatttacccagacagattgctgcagctaccggcgtggacgccttagctcacgccattgagtgctacaccagcaaaaaggctaatctgttctcagacacctttgcaatggaagcgcttgatctgattttgaacaatattattcctgcctgtgatgatcctgaggctatggatgccaagaacaagatgcagattgctgcattctatgccggaattgccatcacagcttccggtaccacagctgtacacgccttaagctaccctttgggcggaaagtatcacattgctcacggcgtttccaatgcaatcttgctggcaccggttatgcgtttcaatgcacctttctgtcaggatcgttttgctttagtatatgatcgctgctgccatgacaccgaaacgatctgccggacaacgaatgaaaaggcagagtggatgattgggcagcttgagcgaatcgtacgtcatttagacattccggccagcttaaaggaattcggcgttccgcttgaggatttggatggcttagtagaggccggcatgcaagtgcagcgcttgctggtaaataacatgcgccctgtaactgcagaggatgcaagaaatctgtacttagaaatcctataaattattttataaataaagaaggagagcgttattatgaggaatattgaattaaaaggcattatcccaccgattttaaccccaatgaatcccgatgaatcgattaatctgaaggagctgtgtaaccagatcgaacgtttgttggagggcggcgtccatggtctgttcccattcggaaccaacggtgaaggctacattctaagtgaaaatgaaaaaattcaggttcttgaggctgctatcgaccaagtgaaacatcgtgttccggtgtatgcaggtaccggctgcatttccacggctgataccattcgtatcagcaagaaggctcaggagcttggcgccgacgtgctgtccattatcactcccagctttgctcttgcttcacaaaaagagctttatgaccactatgtagaaattgccaagcatgtagatattccaatcgtgctgtacaacatccctgcacgcacaggcaacaaattgcttcctgaaaccgttgcaaagctggctaaagatgtagacatcatcatgggtgccaaagattccagcggtgactgggataatttacttgcctacatcaatcttacaagggacttggacaaagacttccgtgttttgtccggaaacgattcattaattctgccttgcctggaggcaggcggtgcaggcggcatcgcaggatgtgccaacgtatatcctcatgttctggcatctatttatgaattgttcaaggccggtaagctggaagaggctaaagcagcacaagactccatcgcctccttccgtgccgtattcaaatatggcaaccctaacactgttgttaaaaaggctgtttctatgctgggttatcctgtaggcgactgccgccgtccattcaactacctgtgcgacgaaggtattgacgcgctaaaacaggttttgaaggaaaacgccgacagagggatgtgctgatatgaatataaaattgaaacctgttattggtatttctatgggtgacccctttggaaatggcccggaaattaccgttcgtgcactggcagatgcaaaactctacgaacgttgtaagcccttggtagtgggcgacgaaacttccatgagttacgctctgaaggtggccgggaaggttcacggcattcatctggagctgaatgtggtttctacccctgccgaaggcaagtacacctatggcaccatcgacctgatggatttggggctgattcctgcagatgaaattccggatacctctaaactggatgtgcctgagccttttggtgtgggagcctgtgccctgggcggcgaggcagctttccagtatgttgtaaaagttattcagctggctacggatggccagatcgatgctacggttaccaatgccctgagtaaggaagccataaacatggctggccatcactactcaggccataccgagatttatgctgattacacggacacaccgaagtacaccatgatgctggctcacggcgatctgcgggtagtccatgtttccactcatgtgtctttacgtgaagcttgtgatcgtgtgaagaaagatcgtgtcctggattgcatccgcattgctaacgaaggctgtaaagcattgggaattaaagagcctaaaatcggtgttgcagggctgaatccccactgtggtgagaacggcatgttcggctgggaggaagtgaaagaaatccagcctgcaattgaggctgctatggctgagggcatcattatccctgaaaagaagccaacccctcccgataccgtgttctctaaggcattgggcggatggtatgacatcgttgtggccatgtaccacgatcaaggtcatatcccgctgaaggtgaaaggctttgtttataaccgtgaggaaaagcgctgggaggctgttgaaggtgttaacgtgactctgggcctgcctatcattcgggccagtgtggaccatggcacaggcatagaccttgcaggcagcggccgttccagcgagctgagcctggtcaatgccatagattatgccatccttatggttcatgccaggaaagaagcatgatattgtataaaaataatcctgtataaaagagaggagttcaatcaaatgactgtcccaatgattattgccattgctatcactgcattcatgattattttgatcatgacagaaaaacttccgttcggcgcacctccaattctcgcatgtctgctgatggttctttttggaataaccgatatcaagactgctttcggcggtttttctaacgctaccattattatgcttgcctcttttatggcaatcgtggcagctcttcaaaaaaccagccttattggtactttcagaaaaacaattttgaacatggctaacaaaggtggatttaaggcatatatactgttatttattatcgttatgctggccagcagtatctttggcacgggctcaactgcattctatgttcttaccttaggtatattatctaccatacagtatactgacaagttaccgcgtggtaaagttattgctgctgctggtttcgcagctaaccatccactaattcctgtaaatgttacattacaatatggtattgttattgctgttttaggagctgctggttcaggtattaccagcgtgtccttagcaaaattctctattgtaaatctaatactttcattagcttatgtagtatgggctttaattggttataaagttctgcctgacaaaaatgttgaagatacagaaatcgacgctgataagtctaaagaaacagtttacgatttaccaaaatggaaagaaaatacaacatatgcagcctttatagcagcagttgttggtatgattcttcaaagcaaggttggcgatgcaggatatatgattccgggtttatctgcatgtctggttttagctgtcggtgttctgaatttcgatgaaattcgtaacaacatcggtgctccaattattttgatgtctgctggcgtgatcggtgttgctgatgctcttggcagtacaggattaactgctttagttggcgaaactgtagctaatatgctgggcactaatatcaatcctttcatcctgatctttgttttctgtatgttaacaagtgtacttgcaacccttacaggatccactataggtactgtgtatgtatttgcacctatggctattgctacctgtatgagcttgggtctgaatccaacagctgctgctgctgcaattgtagtttcgggctggaatggccatttcttaccaattgacggtatgccggctatggtaatgggaattggtaagtacaagctgatcgagttttggaaatatacaattcccatgtactttatccgtctgcttgctttaactgccggagctttgctgttgttcccaatgtagattctaaattacttaaatgaatggtaatctttttgatcggtccatggtctctcatatggtttacggcaggcagtgaccgaacgcattcaatgtatttaaaaaaatatccggctttatatgaaacggatcatcttccgacattttgagaaagaggtatgattatgaataataaatttgaactggagcatatcggcatcaacaccccaaatgctgaggaggcagagaaactggctcagcttctgagtatgatgtttaacctggagcctcgtcatggacaaaagtccgaattcggcggtccttactttgagtgtatgaaggctccattcctgggggcaaacggtcatatcgccatgcgtacacctgatttgaccgctgcagcagaagagttaaaagagaaaggtttctcctttaacatggatactgccgcatattccgaggatggcaaactgaagaacgtatatttagacggtgagtttggcggctttgccatccatattatgcaaaagtaagagaaaaaccaattgaatcaacacattaaaattagcccccggttcaaccaaatcaagtaagttccccacttcaaatgcgaaaagcattaagtgataggtggggacttgcttgtgtcaggtggagtacaagctccacctgacaggcagcgacagctgctgttcggttatgcccgataaagcggggcagggcctcccccgcactatcggggacgccgtgagcaagtagcgaagcggattgcgaatatccgcttgacctgcaccccaaaagtcaggcatgttataaaacaacatgtcagactaaaggagtgcagtttttttatagaggaatacaatttactggttggacctgaatcatataggcattgtcaatatgggccatattacccgcgcaaatgaggattcgctataccgattgtttggcattgatgattggatattctaatgaactggaattaaaaccggcgataggaaccacatccatgtctgttgccactaattcctaccgagctatgataccctatgtgatggaacagtatgacttatttaccggtccggcagaactggaaaaagacaggaggttacagaaggctggtaccaccatagaacgtaacaggcagattggaggtcataaaagcggagaatagcaggagtaaaatggacaggagcagccgtgcgaaacaattttgccctttgatgcattaaaagggtttcgggaggcagtgggagaaaaagaacagattatcgtccctgaacgtgatctgtcagaagagaagaaggaggagttagattggaagttaagacagattcagaaaagagacatagtgactgtggagtattttatgggtagagaatatgtgcaggtaaccggaatggtaacacgaatagatgatgtaagcagaacattggagattggcaatgcaagggaataatagaatggaaaaacttttaattccgcatagttatgtgttttttctggatgtggagtcatggaaaacagaatggccttatcaatggcagcgcctctaactttttaacttgactctccacagagagcattatatgttcatggctatcaataatcataaaaaacatcttcctttcttatggcgacttgtaaaattgatgccgtttgttatactaaaagagtagcaccattctttaagggaagcaagtatgcactttattaatacgacgtatcttttttgatatgtactccatagaagaaaggatgatgtagatgtcaaaaacagttacaatcagcgaaatatgccctacggagctgggaatcaatattttgtccggtaagtggaagctaatgatattgtggagaatttatagaagcaaggtaattcgtttcaatgagctgcaaagacaggttgggaacaattattaacaaaactaagaaagaggagctcatgaaacagattgcaatcttatccgatactcatggtctgctgcgagaacatgttatggctgaacttgctgaagctgattgtaccattcatgctggcgatatcaacacaccatacattatcgagtcaatgcgaaagctgggagagacttatgtggtgcgtggtaacaacgataaagaatgggcagaagccctgcctaaaagcattgccgtcacaattgaaggtgtaagattcttcatcgttcataacaagaaagatgtcccaaaatacttaacaaatgtggacgtggtgatctatggacactcccacaaatattctgctgaaattattaacggagtactgtttctcaatcccggcagctgcggtaaacggcgttttgatttggaagtcacaatgtgccgtatgatcgtggatgcggggcgctaccagtacgaaaaagtgatgattccctatgacatctcaaatgggcgaatataatacatttgcttttaagagtaatttcaattttcaagaaagtcactaaaatataaaaatgaataataaatacgcgtaattaatattttttaatatatttatgaaaaggatgggaatgatgccggcagaatatttaaaaaatattttgtcagctttgaagatctcatcattaaattgggagatgccatgaattgtgagaataaagagattgcagatgccctgcgccacgaaataataatgcttcagtctgaccgattggttaagctggaatcggagaggaaattagaacaaaggcttaaagtgggaaggcaacggatcagggaggtcatcagccagcttgtgtcggaggggcttttgatcaagtatgaaggaaaaggaacttatattgcgcctttagtaaaaaatgaatttgtaaatattatctgttcccccgacattaagttaaatgatcccttttataaccgtatgctgatggaacttacgggatactccgcgaaaaacagtgtgaacatgattccgcttactatggatacgctggaaaacggagatattatttcgccggtattgatgattggtaagtttgcagaagaacatcttgaaaagataaaaaaggcctattcccaaatcatttcctttgagaattatcctgatgatgacgattttgtacagatttattttgaccattttaaaattgggatgaatgcagctaaagttcttgctgcatatggacatatgaaggtgatacacataaccggcccggcatcctttgcttctgctctctatcggaaagacggttttatcagaggagccataaaaaacggaatggaatatactgtattggaaagcaagatgaattttgcaggagggtattctcttggggatgaggttgcagaactggtcagtcaagagcaatatacggcgatattcgccgctaatgattggatggctatcggcttaattcaggctcttagaacaaaaggcctggaggtacccgattatgtttctctgctcagcgtggataatattcccttggcaggtcagttcgctcctgcgctcaccacctactctcttgatgccaatatggtgattgcagagtgtttttcccttatgaatacagccaggacaagtcagaaggagaagcattttcaaaaaagggtgattcttcagcctgtgttaataaccagagatacactgaaaaaaacaggaaatagataataaggagtccaaagtttcttaagtggaaactttcaggactccttatttttgtgtggtaatactagacaagtatgggaaatgaaaaatgtgcaaaataactaaaatacagaaaaaaataattagtttttttatttacttgacaagaataagtgggtgttgtattattggtaaaaatgactataaaaaagataaatgaaaacgttattttaagcaatatattaattaaaataagaataaattgtaaaatatgtatagtaatgcactttatttgggttaaaccaaaagtagtttttgtgaatatttttatattaaaaacaaaaagggtattgtgcaaaatttacaataaaagtcaggagcgaaaatatgaatgaggaaaataaagtaattgctgatgtactgcgcagagagataaaagaacttcaatctgaccgcttgatcaagctggagtccgagcggaagctggagcaaaggatgagggtaggcaggcagcgtataagagaaattatcgcccaattggtgtcagaagggctgctgatcaagtatgagggaaagggaacttatgtagctcccatcatcaaaagcaaatacatcaatattatttgttcccccagcattaagctgaatgatccattttacaataggctgttgatggagctgaccaactattcggcaaaaaacagcgtaaatatgatcccattgaccatagataccctggagaaaggaaatatggtttcaccggttctgatgattggaaagtttgaagcagtggatctttcgagaatcaaggaaaagtttccccgcattatttcctttgaaaattatccggatcatgatgattttgcgcagatttattttgatcattttaaaattggtatgaatgcagcaaaggtcctggccggttatggtcatagacgattgattcatattaccggaccagacacatatgcttccgcactataccgtaaaaacggatttacccggggagccagaaagcatgcggttgaacatgttgttctggaaagtaagatgaacttcagaggcggttattccctggccgaccgggtaatcaaccttgtggagcaccgcagctttaccgcagtttttgccgccaatgactggatggccattggcttgatccaagctcttagggcaaaaggaattgaggttccggatcaggtatcggtgctcagcgtggataatattcctcttgccggtcagtttgctccggcgcttaccacctattctctggatgccaatataatgattgcagaatgcttttccctgatggaagaggctcatgtaaatctggaagaacaaaagtttcataaacgaatcattctccaaccggttctgatgacaagagatacactaaaaaagccgggtagttgagtatagaatcataactgaagtaacaaggttgcttaaaaacacctgaaataaggaaaggaaagagaggaagcagaatgaagaagaggagatttgtaggagtgttactggcagcttgtatggttgctggaactgcaggctgtggaagcggtactccggcaacggccacatcccgggaaggaggtgcagcggctccggcaaaaacatctggagggacgcaggcaggagcttccgggacagacaatctggctcgcggaggcgttggagatggaaggtacaaggaatctccattgctgtatgaactggtggaaaagggagaacttccccaaattgaggatcggcttcccaaggaaccggctgtagttgaagtggatgaaatcggtgtttacggcggaacttatgttggtgctgcctttgggccgagcgtgggtcaggtggatacggaaggattgcgattccagtctatactgaccattgaaaaggatttgcagacctttaagccaaacctgattaaaagctatgatgtcagtgaggatttcactgaatttaccattcacttaagagaggggatgaagtggtccaatggagaggactttaccactgacgactggatgttctggtacaatgatattctcatgaatactgctgtcaatcctgcagtagaagctgcttactgtagtaatggaatacccatggtatataatcagatcgatccttatactctgaccattaattttgaagaaccaaatcccgcgtttgaggttaccatggcccgttattccaccaacattatccggacattttttgcacccaagagttatttggagaagtggcacaaaacttataatccggatgcagataaggttgcaaaggaagaagggtatgaatcatgggtgctttgctttaaaatgcatgtggacaactcgcaggcacagacggataccgaggctccagatgtctatccatgggttttagacagaatcgatacaaacggaaataagtattttgcacgtaatccatattaccatgtggttgaccaggaaggaaaccagcttccctacatagatgagcagaaagcgatgattgtacaggataaagatgtgcgtgcccttaagctgatcagcggtgaaattcatgcggcaggtgagaatcctctccctgtttccgattacaccatgctgaaagaaaatgaggctaatggaaattaccaggtgtatttgtttgataatacaagaggtgcggattgtgcgttttccttcaatctcactgataaaaatccggatttgagagaagtatttaccaatgtgaaattccgccaggcaatgagttatgctctggacagggataccattaaccagaccttatactatggaaaaggtgatgtgagacaggcaaccgctgcgtccaacacctcctttatgaaggcagaatttgaacaggcatttttggattatgatgcacaaaaagcaaatgcattgctggatgagtgcggatatcagtggaacagctcccatactgtaaggcttatgccaaatgggcaggagtttaatattgcattggaaaccattgaagaatttgtgcctgtagctgagattgcctgtgaatactggaatgcagttggtattaaggtttctttaaagcaggtggagcgctcttactatctggaaagaggtattgcaaatgaacgaaacatgcaggcatttactttggattcagtaggtgagtttaacttaagaggagctgcgttcagccgcctgcgtcccgggaatgcatttgacgatctggaatttatgagagcatataaggattactgggacagcaatggaaccaaaggtgagaaacctcctgttgaaattcaggaaatctatgatgactgtttaaggtttggaaccatgtctaatacagatcctgagtatgcagttctgggagaaagtattttaaagagaatcagtgaccagtgctggctgatcggtgtttctgtctccccacggctggtaattatcagcaatcgcctgggaaacacaccaaaggaaggggcttttgctaatgattataatttctggaagccttatcgcggtgatacctggtatttcaaaaattaaggtgtgacttaaacgggaaggcggattacctgccttccctgatatgaaaaggcaaaatggaaataaggagggatgaaagataaatgaagaagtatattgttagaagatttatctacatgattattttgctggcagtcatgtcagtgtttgcctttgtggtgattcagcttcctcctggggattatcttacttcctatatcgccaatctgcagcagcagatgggacaagtagatgaatcggtggttctcagcttaaggcagcaatatggcctggatcagccgatgtggaagcaataccttttatggatgaaaaatatgttccatggggactttgggcagtctttccagtggaaaaccccggttaaggatttgattgcgacccgtatgcccatgactatagttctttccttgatcaccctggtgttctcctatgcgctggcaatacctatcggtatctattccgccagacaccagtattccgtgggagactacctggtatccattctgggatttgttggattggctactcccagcttctttctggcactgattctgatgtactacagcaaccattattttggattgagtgtgggagggttttactcaccggaatttcagaatgcatcctggagtatggcaaaattgtgggatttgtgcaagcatctgcccataccggttattgtcatcggtcttgccagtatggctaatgtgatccgtatcttgagggcgactcttttggatgagcttaagcggccatatgtagttgcggccagggccagaggacttaaagaaaataaaatgatttataaatatccggttcgtgtggcgctcaacccgatcatcagttctataggaagcgttctgcctaccatcgtatcaggcgctacggtaactgcgattgttttagatatccccacagttggctccctgctctacaatgcgctgctgtcacaggatatgtatcttgcaggaaccagtgtgctgatgctaacggcaattactgttgtgggtacctttatttcggatatactgctggtggtgattgacccaagaatacggctgcaataaaggaaggagagtatgacatgacttttgggaaaacgaaaaaagcagcgggaacagcggagatttccatggaagaatcaatctatatggaaacccaatggcagctgatgtggaggaaatttaaaaagcataagctggcaatgctggggatgatgatactgcttatcctttatacggttggtattttcagcgagttttttgcgacacaggatattgccaagagaagcactactgccatcagcatggcgcctacaaagatacattttgtggatgcagaggggaacttttctttacagccttttgtttatgggctgaagcaggaggaggatccggtaacctggagaaaatactatgcagaagacaccgccgtcaagcatgaactgggatttttttatagggggattcttataaactgttgggcgttataacgggaaacattcattttttcgggacaccgaagcaggatgtattctttccttttggtacagactcttccggccggtgtttatattccagggtaatgagtgccttgcggatatctctgagcacgggattggtgggtgtgtgttttaccttcattctgggctgcttctttgggggatttcggggtattatgggggcatagtggataccatcatccagcgtattattgaatttttaatgtccattcccagtattcctctgtggatggctcttgcagcggcctttcccactacatggtcatccctgaaaatatattttgcaattaccatcattctgtccctgatcggctggaccagcctggcaagagtggtgcggggaaagctgcttgagcttaggaatgaggattttgtaacagccgcaagggtttccggagctacagatggatatatcatccttaagcatctccttccgtcctttggcagttatctgattgttaacgtgacgctggcgatacccagtatgattctggcggaaacatccttaagtttccttggaatcggtctcacgcctcctattgtaagcctgggtgtacttttacaggatgcacaaagcattaataccatttccatgtatccgtggatgatgatacctggtctctttgtggttatctctgttcttgcctttaactttttgggggatggactcagggatgcggcggatccatacaaataagagggggaaaagagatgagtgaatacattttaagggtaaataacttaaagacctattttaagctggatacgggaactctgaaagcggtggatgatgtcacctttcgcttaaaacggaatgagacaatcggaatcatcggagaatctggaagcggaaagagtgttacggcccactcgatcctccgtaccgtgcaatacccgggaaaggttttggggggagagattctgtatcatgatgaaaatgaactggtggatttggtaaattataatccggacagtaaggctatgagaaagctgagaggaaaagacatatccatgattttccaggagcctatggccagtttatcgccggtttatagtattggtgcacagatgatggaagcagttatggttcatcaggaaaaaaaggataaaaaggcagccaggcagctgtgcgtggagatgcttcaggcagtgggaatgcccaatgcagagcagaaatttgatgcttatccccatcagatgtccggtgggcaatgtcagagagcaatgatagctctggcgatggtaaacaagcccaaaattctaattgcagatgagcctacaacggctctggatgtaacggtgcaggctcagatcactgatttaatgaagcgtttccaaaaggaatataacatgtccattatctatattacacatgatatgggagtgattgcggaaatggcagattccatagcggtgatgtatctgggaagggtagtggagagcggaagcgtcagggctatttttaaaaaccctatccatccttataccagggcattgttaagttccatgccggtgcttgggaagaaatcaaaggaacggttaaatgccatagaaggaaatgtacccgttccactggatccaccggaggaatgcggattttattccaggtgtaaggagcgctcagggcattgtaataaaagcataccacccctgattgaagcagagccgggacatatggtcagatgctttcattttaaaggagaataaaagatgcaaaaacctttactggaaattacaggattaaagaaatattatccgattgaaacaggtattacgaaggcgcgggtgggggtggtaaaggcagtcgatgacatcaccatcagcattgctaaaaatgaagtgctgggcgtggtaggagagtcaggatgtggaaaaaccactttgggaagaacgattttaagaatcattgagcctacagagggaacggtgaaatttaattttgatgataaggaaattgattttacatctataaataaaaacaaacttagggaaacgcggagatatattcaaatgatttttcaaaatccttatacctctcttaacccgcgaatgactgtttttgatattgtggcagaacccatgaggcttgcaaagcaattcaaagaagaagagataacggaacgggtgaaatatctggttaacagggttggtctggaattaaagcatttgaaccgctatcctcatgcatttagcggaggacagcggcagagaatcgggattgccagggcattggcgtcaggccctaaatttgtggtggcggatgaagcagtatctgccttggatgtgtccattcaggcacagattttaaatctcttgcaggatttaaaggaggaatatgacttaacatatatgttcattgcccataatctgagtgtggtggagcatatatcggaccgtgtttgtgtgatgtacttagggagaattgcagagcttaccgagactgaggagctgttttacaaccctatgcatccctataccgagactttgatttctgctattccggttgcggatcccacggtgaaaaatgaacggattatgctgctgggtgaggtcggaaacgcggcagacctgccttccggatgctgttttcaaccaagatgccggtatgcacaggaaatatgcagcagagtatgccctgccttaaaagaagctatacccggacactttgtatcctgccactttgcgggagagcttaagctgaaagggataggcgagttaaagaaaaaaagtgatgattaaaggaggataagaaggaaatgagaagacctatcaatgtgaaagtgaatgcagatcaggttataggaacccaggaacatttatggaggtggattggatatgatgagtgcaattatacttacataccagagggggtagagcttttagaaaagtttgccgcacttgaagatgccccatattatgtcaggacgcattttatgttctgtaccgggaattgccatggtgcatataaatttggctctaccaatatctattgggaagatgaaaatggaaacccatcatatgactttacctattatgacctgattgttgatgcgattttacaaaccgggaataaaccttttattgaactggggttcatgcctaaggatctggtggatttgaactatctgcctccggcagaaggaaattgggatcaatatgaacaatataagcaaaccggctggacttgccctccaaaggattacaggaaatggcatgattttatcaaagtggtgattgagcatctggctgagcgctatggcatgaatgaaatcaggacctggtactatgaactttggaatgagccggatatcttttactggaaagggacggcagcagaatactgtaagctgtacgattatacggagcatgctgtccatggagtgtctccggagctgagactgtcaggccctgcagtgactggtatctttgaaggaaaacgatcccagaagtttttatgctttttcctggaccactgcaaaaacggaacaaattactgtacacaggaaaagggagcacaattggattttattaccttccatgtaaaaggcggcggcttcccctttgagatgcatgcctctaaagcagttccgtcagtggagagtctggtgcatcaggtaaagctgggccttgactgcattgtggaatatggttatcaggactgtgaggtggttctatcagaagcggatccggacggttgggcagcaggcgggatatatgataatccaaacatgatttttagaaatacagaatattatgccacctatgttgcatccacttatgaaaaaatcgaccggctttgccaacagtaccagatgaaggtaagacctttggcatgggcatttatgttcccgggagaacggtgttttgagggaaccagaacctttactacccagggaattgataaagcagtatttaacatgtttaaaatttatggaatgctgggagaagaaaagctggaattctccagcgatggaacatctggtctggaattcttcagccggcctggaataggagaaaaaaataaaggccggtacaccggagaaggagaagataccgatgtttccggctttgcggtaaaagggaaaaacggcgaggtacaggtggtgatttacagccattgcaacgacagggataagaaggaacaacagtttatcacgcttttggtggaaggaattgaaaaggaaaaggtaagcgttgaacattaccggattgatgaggagcattccaatccatatgcggagtgggtcagacagggcagccctatttttcccaaaggaaagcagtatgaagccattaaggcaagggatggactggaaaagctgtgtaatgatttttcggcagaaatcaatggcggacagctggaaataaaatttgacatgccggcccatgcagtttcatatttggtgattaagtaaagagaaagaaggataacaatgagcagtgatttaagaaaaaaaacattgggggttatccatgcatcccatattaccataaaagccatggaaccatatattaagcaatacatcccgcaagtacagatcatgcacctctgtgatgatacaattcagagggacaatatcaaggcgggcccaggagtgattcctaaggtgaattactttaagtttgcccagtatgcccataatctggaggaagcgggggtagatttaattctccttgcttgttccacctttaattatgcggcagagcttggaaggcccctggtggacactcctatcgcacagatagaccggcctatgatggaaaaggctgtccgcacaggaaaaaaaattggtatgctggcaacgctggtaactaccgtaccttcctccgaacggcttcttgacattgcggcggcagaagcaggtgtggagattgaaagaaagactgttttgtgcagcgaggcatttgaggcatattcaaaaggtgatattgagcttcacaataagattttgatggaagctattgatgaactgtcggatgaagtggactgtattgtgatggcacagctgtccatgtcagcgctggcaccttatttgaaggagaccagggttccggtgtataatagcggggagacctgctttatcaaagtccgggaaattctggaaggcagatagggcagaagggggaatcagatatgcttgagttaaagaaaaaacaggaacttttactgaaagccagagagatacgaaaggatattgtggaaatgattggagtgggaaaggccggccatcttggcggctcctgctctctggccgatatggtaaccgttttgtattttcataagatgaaacatgatccctcagaaccgaaaaaggcggacagggacagattcattttgagtaaagggcatgcggccattgttcaatatgcggctctgatggagtgcggatactttgacaaggaatcccatatccataccttaaagaatcttggcagtaagctgcaggggcatccggatatgagaaagctgccggggattgaggcaaataccggctcccttggacaaggggtatcccttggtgccggtctggcagcaggactgaagctggatggactggattcaaaagtttttgtagcggtgggagatggcgaactggcagaggggcagctttgggaaggttttatggctgcgtcaaactttaagctggataacttaagggtgattatcgacaggaacaggctgcaggctaccggaaagacggaagagcgtttccccattagggaaatcgaaaaaaagatggcagcttttggctttgaggtcatggtaattgacggacatgatatggatgccattgccgatgtctttgaccgggccgatgaggtgaaagaaaaaccggtatgcatcatcgcggataccataaagggaaaaggcgtatgctttgctgagggagttgccgcattccacaacggaacactttcccaggcacaattcagtcaggcaatacaggcacttgaggaggtttcgcatgggaatacataatcaaagagtagaatatggaaaaaccctggttgggctggggaagaataatccggatatagtggtgctggaggcagaccttggaaaatcaaccatgagctgtatgtttgaggaagcttttcctgagcgcttttttgaaatgggcattgcagagcagaatatgaccagctttgccgggggactatccctggcgggaaaaattccttttgtcaatacctttgcagtgtttgcatcgggaagagcatatgatcagatacgccagagcattgccacagcaaatttaagggtgaaaattgtgggctccagttccggaatgtccgactttggagatggggcaacccaccaatccattgatgacattgccattatgagcgccattcccaacatggcggtgtttactccctgcgacggagtggaggtacagatggcagtcaaggcagctgcaggcattgacgggccttgctatatccgtctgtgcagaaatgatctggaggatatctatccctcctctgttgagtataaagtgggagagccggtggtgctttgtgatggaagcgatgttacggtatatactcatggaataatggcccacgaggcgctcaaagcagcccaaatggctaaggcagaggaaattggtgtaagtgtggttcacattcctaccataaagcctctgaatgagaaggcggtaaaagaacttgccgaaggaaaaaaaggagttgtagtttgcgaggagagcagcatttacggcggattgaatatgctggtcagctatattctgcgtggaacagggcttcccatacagagcgtggcggtgatggatgtgtttggtcagtccgcatcttcccatcaggagctgctggaatattaccaccttgatgccaggagtattctaaaggagataaaaaaagctgcaggtaaatagagaaaggggcatttgtcatgaaagttggttttattggtttgggaattatgggaaggcccatggctaagaacttattaaaagcgggatatgagctgaatatctgtgatgtaaatgaagaggcggtaaaagaggtggaagctgcgggtggagcgccatataaaactccaaaggaagtagccgaaaagagtgagatcatcttaaccatgctgcccaattctcctcatgtgagaacagtgatgaaaggaaaagatggtgtgctggaggggataaagccgggaaccattgttgttgatatgagttctattgatcctactgtttctattgagctggaaaaagcagtatcagaagcaggaggagagatgattgatgctcctgtcagcgggggagagccaaaagcaattgacgggacgctttcctttatgtgcggaagcaaagaagaagtgtttgatcaggttaagccgattttagaaaagatgggagcctccgtggttcacaccggtgaaatcggaagcggaaacatgaccaaactggctaaccaaatgattgtggcagtaaatattgcagcaatgtctgaagctctggttcttgcagccaaatcaggagtgaatcctgaacgtgtataccaggctatccgtggcggactggcgggaagtacggtgatggatgcaaaagcaccaatgatgcttgacagaaactttaaaccaggatttcgtattgaactgcatataaaggatttaaacaatgcaaaacatgcatcagaggcagtggatatggatcttcctatgacgaaacaggtgcttgaaatgatgaataaacttcaggaacaaggactgggtgcttatgaccatggtgcagtgctttggtattatgaagaaaaagaaaatgtggaagtgaagagataagatgaaattgggttgttgtttaaatatgttaggaaacagcgtggatccaattggcgcagggtatatccctgcgcttgcttcatcgggctatgattatgtggagcttccgcttgcccaggtgatggagcttccggaagaagagtttgaaagtttattgtttgaagtggagcgttcaggggtttcctgtgagtgctgcaataatttcttccctgcctcaatcaggctgactggagaaatggtaaataaacaagagattgaaagctatgtagaaaaggccatagaccgggcaaagagactgggggcgaaggtgattgtttttggcagcagcggggccaaaaatgttccggaaggatttgacactggccgggcatttgaccagattgcagctgtgttaaagcttgttcagccctatgctttggctgcgggaatctgcattgtcattgaaccgcttaaccggatggaaagcaacatcattagaacgttaaaagagggaaaagcgctgatggacgctgcagatgcatcctcggtgaagcttttggtggattactaccatttttccatggaagaagagtccctggatgcgttgaaagagctgatgccctatatcagacatgtacattttgcaaaacctgaggggcggcgttttcccctggaaccggataagagatacggggagttttttgaagtgttaaaaaacggcaggttcacagagcgggtgagcattgaggcgtattctgatgaaccggaggaggagataaagaaggtgctgtttcttaagaagtatttttactctttatagatagaaaggacaaaagtcagtattttgctgaggacaaagtactggctttttctttttgataaaaattcagtgctatattttttctttttttttgctataattaaattatatgttatggagcagatgaattttaaggaggcgatcagagaataaaaatgaagaacagaatctatattgcaatcgatttaaagtccttttatgcttcagtcgaatgtatagaacgaggttttgatccgctgaccactaaccttgttgtcgctgatgcaagccgcaccgaaaaaaccatctgtctcgccgtctctccatctctcaaagcatacggtattcctggcagaccgaggctgtttgaggtcgtgcagagggtcagggaagtaaatgcagcacggttacgaaacgtgccaggacgagccttttccggggcttccttcagcgatattgaaattaaatcctcaccggaaacctcgctggactatatgattgctccaccgagaatggcgcattatatagaatacagcacgaggatttacaatatttacttgaaatacatcgcaccagaagatatccatgtctattccattgatgagatatttcttgatgctaccgattatctcagcacctacaatctctcagcccgtgaacttgctacgaaaataattcttgatgttcttaaaacgactggaattacaggatcagcgggaatcggcacaaacctgtacctttgtaaggtagctatggatattcaggcaaagcatattccggcggaccagaacggcgtgcagatcgctgaattagacgaaatgagctaccgtcatttgctatggtcgcaccggcctctgacagacttttggcgtgtaggtaaaggatatgctaagaagctggaggatcaaggtctccttaccatgggagatattgcaagatgctctatcggtaagaacaccgattattacaacgaggatttactgtacaagctgttcggcattaatgcggagctgttgatagaccatgcatgggggtgggagccatgcacaattgctgatattaaagcgtataagccaagtacaaacagtattgggtcggggcaggtactgcaatgtgcctatacctttgataaagcgaagctgatcgtgcgggaaatgaccgatctgctggtacttgatctggtggataaaaggcttgtgaccgaccagcttgttttagaagtcggatatgatatggaaaatctgacaaaccccaaggtaaagaaatcatatcacggggcgattaccattgaccgctatggacgctctgtaccaaaagctgcccatggtacggcaaatcttggcggacagacctcctctacaaaactgattctggaagccgtcacagagttgtttgaacgcatcgttgataaaaatctcatggtcaggagagtcaacattacagcaaatcatgttatgaatgaggaaaccgttcatgagacagacaactttgaacagcttgatctctttacggattatgcggctgtacaagcgaagaaagaggaggaagaagctgagtttgcacgagaaaaaagcatgcagaaagcaatgctggagataaagaagaaatacggcaagaatgcaatcctaaagggtatgaatctggaggaaggcgctaccactgtagaccgaaataagcagattggaggacacaaggcatgaagagggcatatgacgacatcatcaatctaccgcaccatgtctctacggcccaccctcatatggaagtcattgaccgggcagctcagttttctcctttcgccgcgctgaccggctatgatgcggctgtcaaagagacagcaaggctgactgatgagaaagttgaattggacgaatacatgaaggatgctttgaacgataagttacaaatcatagcagaccggcttaaagagcatcctgaaatcgctatcacctactttcggccggatgtgaagaagaatggcggtgcctatgttaccactataagtacagctaaaaggatagacgaatatgaacgggttatcattatgaccagtggtgaagtgatccccgttgatgatatgattagtatagatgggcagatatttgaaactatggcgatccattcctgtgatgaataacgaaaaatcagaagttgccgggtagaatactatttttcttatggtaagaaataattataactaacacaagatatttttaaaatatgtagtacagtgtcaactatgcattaaaagaatattactgattttcatgaatacttgggttattcgaaggcagatcccttaaaaattacggttatatatttgtattatgataatgaaatcaggaggtactcaatgctggaaaaagcaatttacttaattaccggcgttatggcatctggaaaatcaacagttgcagaactgctcacttcaaaaattgaaaagagcgtacatttacgcggtgatatatttcgcacaatgattgtatcaggacgtgctgagatgtccccgcagccgtccgatgaagcaatccggcagctgcatctgcgctatcgtttggctgcagatgcggcaaaaacctattatgataatggattttccgtagttatgcaggacaattattacggtcaggaacttgcccgcgtattagatatgctgggagatcgtcgtgtacatgtaatagtactttgtccaaatgtggaaacagtaaagcagcgtgaaacattgcggggaaaggttgggtatgttggttttacgccagaagctctatatgcggattttatgagagaaactcctaaaattggattttggcttgacacctcagcgcagttaccggagcaatcggtggaagatattttgttacatttcagggagcagaggaacgaatcaggtaattgactatgtggaatattatttaaacaatgagattaatgaggcatcctgatggatgtttgacaaactcgcacagtcccatatgaacaggtcactttgttatctaaaacaagaatgtgaattactgaatgatgtgttctgacagaaatgcctgtcttataaatttgaatttgttttatgcacagaatattaaaatagcgggaggtaaagatatggttacaccttatattacatttgcaggaaattgcagtgaagcattggagttttaccagacagcttttagtagtaaaattctaatgtcacagccatatggagagtatgtaccggaaggtgttactgctccgccgttaaatctaaaagactggattttacatgctgaaatgaatatctgtgatacagttttttggtttgcagatgaaatagcagagccagtgtccaaaggtaacatgataaaattaactacaaaagtaccctccgcaaaagaggcacaaaaaatttttgatgtattgagcgttggtgctcatattacccttccgccgacaaaaacattttacagcacatttcatgcggggcttatggataagtacggcgtaagttggaatctcgttgccgaagagccgcccagtcaaccttagtatcataagcattattatacagactccaatttatctgatggtttcaaactgcggcttattattaatagatgagggaggataatatgatattgcctaaaatccgtgacaaaaggttcatcacagttcgccgaggcggtacattgtcagatgaggatcaccatctgttggcggtttgggcagcacagtgcgctcagcatgtcctgcactattttgaagaaatgcgtccggatgatgaccgtttgcgaaatgatatttgctggtttgtgttcaacaaggatttgtaaacgatactacaagcagtcaaattatattgactggaatgaatgaagtattgcttcaagatttgctgccggaaaggtgggataacaaatggaactgaaaaaaataagcggcaggatattttattatccacatcagcaggaaacagaccgtcctatgctggtttatctaaaaggtgaaaaaattatgattgccattgatgcaggtaattcagcagaccatgttgatgaattttataaagctttagaagttgcgggattaaaaaagccggattttacaatcataacccattggcattgggatcatacatttggaatgcatcatattcatggactatccattgctcataacagaacgaacgagttcttggatattgaacgagccaaactatcagacagtgcatatatacaatttctaaaagagaatgatgagtgcctcagcagagagtatgaagataataagaaaattgttgccgtactatcggatattcaatttgaaaaagaacttactgttaatttgggcggaatgactgcaaagatcttccatgcagaatcgccccactcagaagataccgtgcttatttatgtgcctgaagaaaaagtattgtttttgggagattcaacaagtgaggatttctttaatgattcttacatggatagagagaaattagagaaattgataaatctgatagaaggtacagattatcaatattgtattttgggtcatgcagacccacttactaaatgtgagttattgtattatttgaaatcgatataatgtttctttgcagaaaaaatatgcaaattccaatttgtcggtttaaatcttaacttatagaaatggaacacttaacaaaaagcaaggacaataatgaaaggtacattttcaaaacatggaaatgtgccttttttttgataaatgtttttcaatgggtatttcaagctgccttattatattgcttcgcaaatctgttgaattggtttgttactgattcaaagttctgacatgtataacttgatctttgcaataaagaatccgtcgggagtttggtacaggcttccagtacctacatttgatactttgattgtaccggaattatttttttgaaaattttcattttgacatgcagtatttaaattctaacaccaatgattaagcagactggaatgataagcattcttaaaacgtagaagagaatcatggcaatgataatgatcagagcgaaataagaatgaagtcaactaaaaaagtatacaataattgatttaaatgcggcatgttatgcaatatttacaacaaaatgtatacattttgtagagaatgtcaatataatcaatgattttttaatgatataatgtatacgaaaataagaaaaaataagtgtaaaagtaagaaaagcacacataaagaatacattatgcagagaggggggataattttgaatcatgtgtgcaaaaaataaaaattctaaaatatcaggaggaaggtttaatgaaaatgagcaaagtattggcaataatgctggcagcaagtatgactttttcactagcagcctgcggcgggggggccgtcagcaattccggaggaacggctttacaggcacagaattccgatgcctcatcttcgggaaacagcagtgcagatggcagcagcacagattccggggggaaagatacagtcattgtagcctgtgccgcagagccggattgtttcttcccattccacagttcattgaagacaaatatggatgaggttccgattctacataatgtatacgaaacaccgattaagtttggcccagacggttcccatgagcccctgctggctgaaagctgggaggtttctgatgacggaaaaacgtacaccctgcatatcagggatgatgtatatttccatgacggcacaaagatgacagcagatgatgtggccttttccattgacacagccggacatactgcccagggagccgcacagttggctaatttagacagtgcagtggcaactgatgacaagacggtagtaattaccctgactgctccttatggcccgtttctgaatgctttggctggacgctatgcactagtggtatccaaagcactgtatgagagtgtgggagaggatgcctataatgataagccagtcggaacaggtccctacacctttgtatcccgtgtttccggtgaccggattactatggaagcgtttgataactattggggcggggtaccggctatcaagcacgtgacctatttgattttaacggatatcaatacccagatggtttctttggaaaatggggatatcgatgtcttgattcaggcaaatgttggatctctgaccaagctcaaatctgataaagtaacatggcagacaacagatgcatcttctatgtgcagtatgcatctgaacttaaatgaaggcccggcaaaagatattaattttagaaaagcactgatgtatggtatcaacaaagaggaagtcaatatcggtgtttacgaaggctatgcaacggttggggatattccgattgctccttccttctctggaagaccggatgcgggcacctatgaggtggttgagtataatctggatacagctaaagagtatctggcaaaatccggctataacggggaagaatttaagattctgaccgtagcaggaagcaggaatgaaagcgcttcacagattattcagggacagctgattgaactgggaatcaattgtacggtaaatgcgctggatgctgcctcctatcaggcagcggcagatgccggcgaatttggagcgtctgtccgggcgcagggagtgtcggttcttgatgcggacggcatgtttttccaatatcacagtgagtttctggtacagccgggactttacgatgcgggaatcacctctcctgagatggatgcatacctgaccgcaggaagaacggaaactgatccggaaaaaagaaaagaaaattatgcggctgcctgcaatttgattgccgaacatgcattaagtgtctgcttgtattatgaagtaaatgcctgtgcatttaattcatcaattaaaggtgtggtgccaagagcattgaccggtctctattattttaatgactggagttggtaggagtcgttttcagtaaacaatcagacgggacaagaggggagttaaaactccccttttctaaaaatgaggtgtagtatggctaagtatgtttttaagagaattctaatgctgattccggttgtggtcggtattacaatgtttatctatatcatcatgagcatggctcctggtgatccggccaagctaatattgggaactgatgcatcatatgaagaaatcgtggcaaaacagttggaactgggactggataagcccgttttaatacgttatttcagttatatgaaagatgtcttaatcggtaatttcggtacttcctggtacaacggctatgatgttatgtcagaatttgtatcaagacttcccaatacgctgtctttaggtttgatgtccatggcaatcgctgcttttattgggattccgctgggagtatttgctgcggtcaggcaaaacggggtgttggactatgttacgctggttttggcaatgcttttttcatctctgccagccttttggtttgggctgatggcacagattttcttttgtattcagttggggtggtttccggcaaccggagcgggatcggtccgtcattttattctgccggcgattacgttagccagtgcttcccttgccggtcaggtgcgattgaccagaaccagtattctggaggtcaacaaactggactatgtccggaccgccagatccaaaggggcctctgagggccggattattatgaagcatgttttaagaaacggtatgctgccggttgttaccagtatcggcagccagtttgcaaatttggttggcggtgctattgttacggaaactgtatttgctatccccggagtcgcaagccttctgatcaatgctgttaagctgagggatatcccggttgtcatggggattatcgtaatcattgcagtttttgtcggtgtggttaatttgctggtggatttgacttatgcatttattgatccgcgggtaaaactgggctcttgataaaaaggaggataataaattgagtaagcaaaaaagcaaaattgctaataaaagccagttagggatgattgttttccgtttccgaaagaacaagctggcgatggtggggctggccgtcatcacggtgctggcgctgatgtgtattatggcccctctctatatacaatatgaagcggtctacaaacaaaatatgataaatcgttttatttccccgggagccgaattcatcttcggaaccgaccagtttggcagagatttatttgcccggatcatttatggcggaagaatttctctgctggcaggattagttgtagtggcactggcattgacagtggggataaccctgggaggcattgccggctattgcggcggcagggttgatgatattattatgagaatttgcgatatcttcatggcagtgccaagaatgcttttgtctatggcggtagtatcagcattggggcagggaacttttaaaatgttgatcgctttatccatcgcagcatttcccaaatatgcacgaactatcagggcatcgatcatgattctcagaaatcaggaatatgtggaggcggctaaatgctgcggaaccagtccgctgcggattattttcaagcatgtggttccaaatggtttgggaccggttgtggttcaggcaacgttaggtttgggagaaaccattctggccatagcatcactgggtttcctgggcattggggtagcatcgccaacaccggaatggggcactattttatcagaaaaccgaacaaatatccgttactatccttatttgggtatggtccccggcatatttattgccatttcggttatgtgcctgaactttatcggtgacggtttacgggatgcgctggatccgcggacaaagagctaaggggtgggaaagatggaaaaatatttacttgaaatagatgatttacatgttcagtataacactgacgaagccgtggttcatgctgtcaatggatttaatttaaaattgaaagccggtgaaacgctggggctggtgggagagaccggagctggaaaatcaacagttgcgttaagcgttttaaagcttttgcccatcagagtcggtgaaatcacaaaaggaagcattacatacgacggcattgatgtaatacatgctaacagtcacacgatgcgggatattcgcggggctcggattgccatgatctttcaggatccaatgacaagcttaaatccgattattccggttggtgatcagatctatgaggttttggaattgcatttcccggatatgacaaaagaagcaaaggataaaaaggtggattcgattcttgaactggttggtattcaaaagcatcggaagaccaattatccccatcagttcagcggcgggatgaaacagcggatcgggattgctatggcattggtcgcagaaccagagctgcttttggcagatgagcccaccacggccttggacgtgaccattcaggctcagattcttcatctaatgcaggaattaaaggagaaatataataccgccatggttttgattacccatgatttaggggtagtggcagaattttgtgagaatgtagctgtcgtttattccggggaagtgatagaacagggctcggtagaggatatttttaccagagcgaaaaatcatccatataccgaggggctgtttaacagcattccaaatctaacgacggatatggagcggctgattccgattcccggtttcatggtggacccctccaaccttcctgccgggtgtaaatttgcagatcgctgccggtactgccgggacatctgcaggcagcaggagccgccagtatttgccaaaggcagccaccgcataaaatgttttcaatttcagaccaaaggaggggaataagaatgggtgcgccgattattgagaccagaaacttaaaaaaatactttaatactcccaaaggtcttttacatgcggtggatgatgtgaatatccggattaacgaaggcgaaacactagggattgtcggtgagtccggctgcggcaaatcgactctggggcgaactctgatgcggctgctggatgccacggaaggcgagattctctatcagggtcagaacattctgggctataacaagaagcagatgaagcagatgcgtaccaacatgcagatgatttttcaggacccatttacttcactgaatccgcggctttcggttggtgagatcattgctgagccgatgaaagtgaccaagattgtccgcggccaggagactatgcggtacaaagtacaggaattgatggatatgtgcggcctgccggaacgctactacaacacctatccccacgaattggatggcggaaggcggcagcgggtcggtttggcccgtgcattggcggtcgatcctcggtttattgtctgtgacgaaccggtgtcagcactggatgtgtcgattcaggctcagattattaatctgctgatggatttgcaggatcaaaaagggctggcgtatatgtttattactcatgatctttgtgtggtccgacatatcagcaataccattgcggttatgtatctgggccaggtggtggagtacgcctcccgcaaagaattgtttgcccatcagtatcacccctataccaaggctctgctttcggcgattccgaccaccgatttggctagaagggatcgggaacgtcacatgcttcagggggaagtcggcaacccgattaacccggagccgggctgccgctttgccagtcgctgccaatatgcagatgaaggctgtaaacaaccccaatccttacgggaggcagtaccaggacattttgtccgctgcatgaaagcagacgtatgaagatttctatcaaaggctcaaaaagccccgaatggatataaatatctatgaaaaacgtggtgatgaattgctggagagaatttggaagcactcggaacaggtaaggcttccgggagagtgtgcttatcatgccggccagaagatgaaaaaacagaaacaggtcaatatatcaaaacagacaatgctgcggctgcaaaagctgtactgggtacaaaacccaaaacaggaggatggatatgagcgaaacagtgtggtggaaaaaaccaatgagaatcattcaatataaccttcaggttgctgatactccgttaatggatgcacaaaagattgccgaagagctggaggcagattatgccaatgtggtagtcatcaatgtgggcggaatttatgcatggtatcagagtaaggtgaagcatcatcatattaacgaatttttaccgccggagagggagctgcttaaggaactgatcgaggcctgccatcagcgggaaattaaggttattgcccgtttcgatttcagcaaggcagaagatattatttatctgaaaaggccggactggtttgttcagcagcaggataaatcaccgttgatttacggaaaagaaagaatgggaaattggtcactgctcctgactacctgcatcaacagcggataccgcaacgaagaggtggcggttccagtgatggaagaggtcgtcagagaatatgatattgacggcatatttttcaatgctcctcatggttctccgtgctggtgtgaaaactgcaagacaaaatatagaaagctgtacggaacagaactgccgacagcagcggaagattttgatactgattggaattcgctgtgcctgaaagagaatatcagcctgctgaatgatgcggttaagaatatccgcagtgatattccgctgattctgtattattacggctttgatctgctgccgggagagacctgggcggtagataatttggatgaacgttatgcttctgcagatttaatctgtaccgaagcacaggatgtcctatcggttggggtaaagaatgttccggctatatggaagccctatataaatatgaaaatcggcaatgcagttcccggttatccccggcccttcggaatcattcattcctgtccgggaatggattggcgtcatgccggacttccaaaggcagagtacatgttctggatggctcaggttatggcaggcaatgctcatctgtggcattcgattacaggttttaatgatacagttacagataaacgattgctgggggctgtcagggaaatcaaccggatggtcagcctttgtgaaacacagatggatggagcgtctgcttcttcgcaggtactgctgctttgggacggttcgcgcagtgcctccggctgggtggatggaatgtgtgccacacagtatcagtttgacatcatggatgtccatcacatgaatttggaccggatgaaagaatatcaggttctggtcgtaccagctggcttttatttgaatgagaaagtgacggcaatgttggtggattttgccggcagcggagggcagctgcttatagaaaagcatgatgcatcggcaatccagaaactggcggcgtatatgggaatcaagccggcggtaaccgaaagtgattcccttactgccagctatatccgattagaaacagaagatacaagcctgcgcaatcagctggaggaaatcacttttattccattgaggggacaggtgctctatatgaagcctcaggacaatactgaggtgctggctaccctggttcctccatttgctccaatggacgcagtgggggctccgccggagcgggccagtatgccggtcagccagacggatctgccgctgattctgcgccattcgtatcaggatggaattgtgatgaccctgggttttggtctaagtgaattgattttagactatcatttggaagatcattacctgctgatgcggaattgtctggatgcccttaccggtgtttcaaaagaattcatcatggctgaaacggtggctggaattctgaccacggtatatcataatggtcaggacatattagtgcacttggttaacggtgtcggccagcggccgttgatcagctcgattccttatttcaatgccggatttacagtaaaattgccggaaggcagaaccgccgtaaccgtatctgctgtaatcgaggatgaagcggtaagctggcaccaggaaggcagtcaggtgattgtaagtttaagtaaattatccgtttggaatatgatatcaatagaaacagcataggctggcagaatgagaggtaagtatggcttggtggatgaaaaataatctccggatgattcagaacaacatccgggatattgatgcaaacatggatattgacaaacacattgaatggctgaaaagttttgatgtaaatgtactacagattggctgcgggggaattacggcctttcatcccagcaagctggagtgtcaatggaaaagtccttatatggaaggagatttttttaatgaggtagtaactaaatgtcatgaaaatgacattaaagtcattgcccgtttcgatttcagcaagacccatgaacggttctatgagtctcatccggaatggtattcgaggaagcctgatggttccccaatacgctatcatgatacggtagcaacctgtgtaaatggtgaataccagcgtaaatggtctctggaaatcatccgggaagtgctggagaaatatccagtagacggaattttctttaatatgttcgggtatatcacctttgattacagcggcaatgatgtgggaatttgtcagtgtgagggttgtcagtcgcgtttctatgaaatgtacggtgagccattgccggagaaagaagatgacagcaacccggtattccgcaaatatcaggaatttaaggtgattacgttaaatgaaattctgaccagcattcacgagctggcccgttccgtttcgccggaaattgcggtcagtacctataccgcccacggcgtggatattgtcagaaatgagtcgaattcggcactggaccggctgcttccgttctggatttacaacagtacggataatgttggggtgatagaaggcagctatgaaaacaagatcagttccaattgtgccattaatgccgttgacctgccctaccgctttatgggagtttccaaatatttgaatgaaatacgtttatatggtaatctggctgccgggtccgggcttgactggtgtattatcggaaattttgatgattatccggactatgataatttcttgtcagttcgtgaaatcttcaaatatcataaacgttatgagcggtattacggacatttcaggcataatgaaaagatcatggtggtttgtgatacggcccgacatgtgatcaacaaagaataccgtggactgttccggatgttgaaagaagaacatattccatttcgaattgttgaagttgcagcacttgaatcaataatggatgaattcgaccgctatgacttgattttcctgccggcagtgaggacactctcagaggcggttaaggcggcactggttaaaaccactgcacgggtagttggcagcggcctggcgctggagggtgatgaagcttatgtcagtgagctgtttggagtccggttaaaagaacagattactgatgtgagaggcacctatctgctgacagaacccaagtttgtattctctgattttaaagataagcaatgggtctttctggataagcagtatcgtgagatagaactcttagagaaaaccggaggtctgctgccaaaagttgaaaaggcgatgtttggaccgccggagcgctgctttggtcatcaggtaacaggggccagtatgatggcattcagtgaaaacgggaatatctacataccgtggatgattgcggaaaattactatcaatacgggtatgatgagttcaaacggctgttgctggatgtgactggggctgctgaaagcaggccgtttattaccgatgcggggccgatggtggaaatgttcctttcacagattgatgattcccagcatctgctgcagctgattaatatgaccggtttcaacggaatgaccttctttgagccgtcagagattccggagatatcagtggtattaaaggatataaagccggcctccgtgaaggtgatgacgaaaaccggattacaggataccttctataagaacggcatgaagatatcgatggaaaagggtgaagtttataaagcatttttagtgcagctttaatgctgttgcaaaggagggaatcggacaatgaagatcgtagttttggatgggtttacagaaaatccgggggatctcagctggactggacttgaacagttgggctcactgacggtatacgagaggagcccctgtgatgacgaggctgaaatcatcagaagaatcggtaatgccgaagctgtatacatcaacaaggtgccgttgacggcagccgtcatcgaacaatgtgaaaacctgaagtttatcggtgtgctggcaaccggatataatgttgtggatatccgggctgccagtaaaaagggcattccggtatgcaacattcccacatacggtaccgcagcagtcggacaatttgccattgcactgctgatggaaatctgccaccatattgggcatcacagccaggctgtttacgaagggcgctggagtgccggtcctgattggtgcttctgggattatccgttgattgagctggcgggtaagacaatggggattatcggttttggccggatcggtcaggcgactgcagggattgctcaggccatgggaatgaagattttagcttatgatgcttatcagaacccggatctggtaacggatacatgtagttacagtgctcttgataccttgttggaggaggcggatgtaatttctctgcactgcccgctgcttccggaaacggaaggaatcatcaataaagagactatcggggttatgaaggatggcgtgattattatcaacaattcccgcgggccgttaattgttgaagctgatctggctgatgcattgagaaacggcaaagtatttgcagccggtctggatgtggtctcatcagaaccgatccaggaagataatccgctccttcaggcaccgaattgtatcattactccgcatatttcctgggcgccgaaagaaagcagggctcggctgatggagattgctgtagaaaatttgaaaagatttattgacggtactcctgtaaatgtggtaaatccttaataatggagagaaaaaatgaacgaatctattcataagtattttaaagttggattaattcagtggatgagtcatccgcgaaaagatattctggaatcggtccgccagattgcggctgatgatttttttgacgccattgaaatcggtccgatcaaggacgatgagaagcgtgaacggaccaaagtgttacttcagcagagtcatatgacggtctgctatggcgcacagccgcgcttactgggaacggggctgaaccccaatgacttaaacgaagagggaagacaaaaggcggagcagactctgctggatgcggtggatgaggcagccgctctgggagccaaagggattgcctttttgtcaggcaggtggctggaagaaactaaggatgaggcttaccggcagctgcttaaaaccaccacaagtgtatgcaggtatgcggcagcaaaaggaatgaatgtaaacctggaagtgtttgattttgacatggataaagccgccttaattggcccagcaccctatgcggccaggtttgcggctgatatgcggtgccgctgcagtaattttgggctgctggtagatttatcccatttcccgaccacttatgaaaccagccaatttgtcatccggacactgcggccttatattacccatctgcatatcggcaacgccgtggtaaaatcaggttgtctggcatatggggatttgcatccgaggttcggctttccggacagcgcaaatgatgtgcctgagctgacggattttttccgggtactgaaagacgagggcttctttaacgaaaaaaacccgtatgtactttcttttgaagtgaaaccatgggataatgaggaagaagatattattttagcaaatacaaagcgagtaataaatcgggcctgggcaatggcataaaaccgcccggcaaggaggataacataatggatgagaaaataatgctgaattcgacggacactaccgggaatatgattgcccaggagatacgcaaaggcatttccgaaggacggtataaaaccggcgaaaagattaaagaagcggatttgtgccagcggtttggtgtgagccggacgccggtgcgggaagcgtttcgtctgctgcagaatgaaggccttctcgttcataatccccagcggggcgtacaggttccggaattcagactggaggagctgatgaacctccagcaaatgcggacaacgctggaatgcttatcggcccgcaacgcagcgcctcttgcaaacgaggagaacatatggcggctgcgggaactcaatcgtcagatatcggaatttgatgagaacaatacccataaaaccgatgccctggatcgtgagttccatctgacaattgcccgtatcggcagcaatccatatgtaactgacttccttcagaatattttaacgagatatgagctctctacttatgtaataccatttcaggggagccgtattccttatacgtataaagagcatgaggatgtgattacggcattggaattaaatgatgccgaactggcggaaaaatatatgagtattcattttcattacagtaccctttcgttaagtaaaaaattggcgagatatatggaggaaatcaagcagaaaaaaaggaagaaacgtaattaaatgtactggctgttatgaatgtaaatacctgaacaggatgattatttataacggccagtttacaggatcgcataaatatatgataggaatgattgcagctcgcttaacgacaatagcattttgttgcaggaagttaaggtttttaagacaaaaatacggattttatttcactgggaatgtacttgatgcaggtagcaggcttaactatgtggtcggttcatgtttttaatgtacacggcttgacggtattggcgattaatatcatgacacttgtgttttcagcaattattttattctgtaaaatgaaatataaatagacgtgaaaggcggtattataatatgaaaatcgggtttattggattaggaattatgggaaaaccgatggccaaaaatctagtaaatgcaggttatgagttagttgtttttgattttaataaagaggcggtggccgaactggtatcctgcggagcagcatcggcagaatccggcaaagaggcggcggctcaggctgaagtgattataaccatggtgcccaattcgccccatgtcagagccgctgttctgggtgagaacggggtcgcagaaggcgcaaagccgggaacggttttaattgatatgagttcgatcgatccaactgagagtaaagccatcggtgaggagcttaagaagttcgggattgagatgctggatgctccggtctccggcggagaaccgaaggcaattgacggtactctgtcggtaatggtcggcggaaagaaggagttattcgataagtattatgaaatgctgatggtaatggccggttcgtccgtatatgtcggggaacttggttccgggaatgttgcaaagctggcaaatcagatggttgtggcagtcaacatagcagcgatttcagaagcgctcacgtttgcaaaaaaagccggtaccgatccggggctggtgtatcaggcaatccgcggtggccttgccgggtctacagttatggatgccaaaacaccgatgatgcttgagcggaactttaaaccggggtttcggattgaactgcacatcaaagacttaaataacgcattaaatgcggcacatgcagtcagttcaccggtgccgttaacaggacagctgatggaaatcatgcaggcattgcgggcagatgataatgacaaggatgatcactctgcgattgtaaaatactatgaaaagatagctaatattacggtttgtccggacaagctgcaatagcagcgatgaggtcatgcccggtgaagcggggcacgctgtgagtaaatagcgaagcggattgcgaatatccaattgatttagtggataaaaggtttgtgactgaccaatttgtttaatggtcggatatgatattgaaaatctggcaaacctgaggataaagaaatcatattatgggggaattactactggccgctatggacgcaccgctgataaaaatcttctggtcaggagagtcaacatcatagcgtatcatgtaactggtggatgtggctgaacgcactgggcaaaattgtgattgacgatgccccgtgttattggatataattaggttagctataagcaaagtaaagaagttcttgcggcgcaagagcttttttgttattatgatgtagaaattaggcggtgagatgaagtggcgaacagatttgaagacaaagtggcctcggtaagtaaggccctgaccatattggaagtattgagcaacgagccggagggattggggctgctggaaatcagcagccgtgtcgatatgcataagacaacggtttaccgacttctgacatcattgatggagaagaacttcgttgagcaggatgaacagacgggacgatattctatgggtcttaagatactgagcctggccaatgcattttatgagaaagtggatatccggattattatacgtaaatacatatccggacttttggctggagaggtaagttcctcttctgaagatcagtgttcagaagaaggttttcttttggtcagcaaacgcatggaacacaattttgttgtgatggactgtctggaaggcggcatgctggcacctctgcgtgttggagaggtacttgcaaaggagagcatcatcgtgaagacttgctgtgccaatattgcagtttggcagcaaggcaaaaacatgtatccatcaggacttactgtgaagcaggaagcagaataccgccaggaacttaagaatatctctattcagggttacggatattctgaacgggacgtgggtgctctcccctgtgcagcagcgcctgtatttgattattccaaaaatctggtatgcgtgttgagcatccattccatatcattggaggatcagaaggtacgctccagaaaaatattagatttgatgaatacagtaaaccgtatttccggtgagttgggttatgcaggatatttatagataaacagaaaaacgtgtaatgacatttacaagggcatggagaagagagagttatgaaatctcttctccatgcccttgattttgtatttgtgcatttgtaataaaatacaaaaaataattgacattaaagtgtaagagatgtattataaaaacacaaagttgtttcgtaatacgaaactaatgcaaataataaaccgtattacgaaatgataattaaaaatacgaaattcaaaaaggaggtaactatggaaaagtacacagcaaaggtcagcagtgtgacaactgcagaggtaattgtgtgcggtgggggatgtgccggtgtggtagcagcgattgccagtgccaggaacggggttaagacaattttggtagaaaagacatccattgtaggaggaacagcgacgaatggtttggttggaccatttatgacatgttttgacccttcaggcaaacagcagattatcaaggggatttttaatgaaattattgaaagaatggaagaaaagggcggtgcagttcatccatctaagacaggggctgtaagtaactatggctgttatatcaagctccgtcataataatgtaactccgtttcatccggagacactaaagatggtgcttttggagatgctggtggaggccggcgtggaatgttatctgaacaccaccattctggatgtggagatggagggtgacagagttactggaattgtggcatttgatggaaacgacctccggctgtttgaggggaaaatagtaatagactgtactggagatgcctttgtaaatgtaaaggcaggtgctgcctgtgagatggaggatgtggagacaggactgcagcccatgacactgtttttctggatttacaacgctgatgatgagaaaatcgaggaatttttaagccaggacgaagaaacaagatacctgccttaccaccatatcattgagaaggcaagacaggaaggcaaattcaacattaaccggaataagataggcatgtaccacatggtcaatccgggagagtggagactgaataccacccgtatccaggggaggaatccggtggattccaaggatatgaatcaggcttatatggatggcatgagacaggtggattttctgatggaattcttcaaacagcttcccggcttagagaatgcacgcctggctcaggtgggagcaaacgtgggagtcagggaatcaaggcggatcataggcgaatacatattgacggaacaggatatgattgagaacacagagttccaggataccatagccctgtgcagttatcctgtagatttgcatccggcgaaaggagctctcactgggacgagctataagaaagagcacacggatgtggccgatgtatatgagatcccattccgtatccttctcaccagagatctggataatgtcctgacagcaggccgctgcgtgtcggcaactcatgaggcactgggagccatccggattatgccaagtgtctttgcaatggctcaggcagccggaacagcagcagccctggctgtcagaagtgatataaagctaaagcagcttgataccaaaagactgcaggaaatactggaagagcagggacagtgcttaaaaaggcataaataaattgaaagtacatactcgattagaagaaagaagagggttgggattatgaatgtgtcaacagttttaattatagcggcatttattattatcgttgccttgatggtaacagataaaatcaatgcagtggctgctttgccgcttatggcagtggtactctgccttatcgtaagaatacctgtaaaaacaattatgaatgatgttgtaggcggcgggatctccggtctgtcgggtgctatcttttcaacattgatagcggcggtgcttggagaagtgatccgaaagacaggcattgctgagaaattaatccgcagtgcggcagaaatgggaggggataatccatattttatggctattctttgttttctggcctgcggtttttgtttcatcggtttaagcggagtaggcgctaagattatgcttggcttaattgtgttcccgattatgctgtctgtcggtgtacctaaggtgattgcagcatttgtcatgcttgcgggaacgtctattggatatttcatgaatgttgcaagatggacgtttatcggtaatcttgtaggtttggaagcgtcagacccgcttgtgaagaatacggctatcatgctgattattccaggtattattatcagtattcttttaattgttattggaatcaaggtaaaggggccggtattttcctggtccgcagagaaaaaatcagtctcagccaatgacagcgatgtacctttatacgccgtacttgctcctgtgattcctctggtacttgttatggcatttaagtgggacgtgaatactgcactgattgcaggtattatctatgcagttttatgtacccaatggaaagtgggattcaagggttcccttgatttaataaataaagcagcatttgatggttttgccaatgtttctgtgacaattgtgattatgatgggcatcggtatggtattggcagccgcaaagcaggagcttttactggcccccatacaggcgctgcttacaaaagtcgtgcccacatcaccgcttatgattattctggtatttggagccatcggaccgttcctgacaatgtaccgaggaccgttaaatccttgggggctgggggctgctctgatcggtattcttctgggaacagggcttcccattggactgattgtaactttggcctggctttatgattattatgtggcagtgaatgacccgacagcttctcaggtaacctgggcatgcggttatatgcagctgggagttggaaagtatacgcggggaacattcctgatcgatgctctctttgtactggcaggagtcattcttgcagtagtattctttatgtagtaaattgagtaaatgaggaaaaaatgatgggaagaaaaataaggattggaattgatgtgggaggaacctttacagatgccattgctcttgataatgagacatatgaaatcgtaggcatcaaaaaggttcacacgacccatcatgcagaagaaggagttacccgaggggtaattgacatattgaacatgctgctggaggaaatccattgcagctcagaggacgtggtctttatagcgcatgggaccactcaggcaaccaatgcgcttttagaaggcgatgtggccgaaatcggtattttgggtatggggagcggtatcggtgtggctaaagtaaaagcagatacggatattggaggagtaaaactagaggatgacaaagagataaaaacctcctataaattcatcaatacagggaatggagtgccggaggctgaagtcattcaggcagtagaagattttaagaaagagcatatcaatgtacttgttgtaagcgaagctttttccgtggacaaccctgaaaatgaggagaaggcagccgaggctgcagccaaagaaggcatgatggtcactgcaacccatgaattgtcgaaactttacgggctgagggcaaggacgaaaacagcagttattaatgcatcaattcttccgaagatgatgcagacagcggatttgaccggtcaggcagtaaaagatgcacagatcaaggcacctctaatgattatgagaagtgacggcggtgtcatgcagatcgatgaggtcaaaaaacgtcctatactcactgttttgtcagggccggcagcaggggttgcgggagctttgatgtacgaaaagatatcagacggaatctttctggaagtcggaggaacaagtaccgatatatccgcaatcaggaatgggaaagtagtaacaaagtattctaagattggcggtcataatacttatgtaacatcactggatatccatacaataggtatcggcggcggaagcatgatacgttttaaccagaagaaaatcatagatgtgggaccgagaagttcccatattgccggacttgcctatgcatgctttgcagattcaaaggagctggaaggggcaaaggtgatcagtgtcactacgccaaaagataaaacctgtgatttcctggcattggagacgaaagaaggaaaacgttacgcagtgaccttgacttgtacggcaaattatcttggaaaagttggagatggcgattatgccagggcaaatcccgaaagcgtcagaatcatatttgagatactggagcgggaatttggccgcccggcacaaagtattgcctcggagattatggttatagctgttgccaaggttgttcctgctgtagaggaatttgtcaaagaatataatctgtcgaaaaattaccttatactgacaggaggaggcggcggggcaagctctgtggtgccatacgtggcggaacagatgaagcttaagtacaaagtcgcccagaatgcctcagtaattgctaccataggtgcggcattggccatggtgcgcgattctgtggaaagaacgattgtaaatccaacacaggatgatattatgaagataaggaatgaggcggagcaggctgcgatccgctcaggcgcctcaccggagtctgtggaaataaccatagatattgacacggccaagaatattgtacgggcaactgcagtggggactacggacttaagtgcaaagacatctcatggagaagtgctggatgatgaacagattaaggataaggtaatccaggctttcagtaatcaggaagtaagtgctgtcaatgatatctatcattcaccgactctccatgcctttgacgttgtgtcatcaaaaaaaggttttcttccttttatgaagaaaaaaatgcggaccacttgtgtaatcgatatgagcggagtgatccggttaaatgtggatgacagtgataattatgtaatccgtgaatcagacagagcatcttttgtaaaacgggtggaagaacatatgaagttcgatgaatcagggaaaacttctccgattatccatctggtggtaaatggcaagattgcagatttgtccggattggacagcgaagaacagattatggctctggcagaccttgagtttaagcggctgacaccaggcagtgattatctggcaattatcaagaagagataaggtgaaaatatatggcacaggaatacagcagagtggaaaaatcagggcttcagatgtttgaacggtttgaatatacaaaatccctgcctgaacaggaaaaaatcgaaataatccgggaggctgtccggtttggagagaagagagccgatgaacttaaggctgagttccgctcagcagtacccagccagattctcaacatgcagggaattcttattcttgaagaaaacgacaaggataatacccgcccaaactttgtgaaatttgcagagtttcatgttaagcagaaaaaggtgctgctgaacagtcaggtgcttcgtataatatcccggcagatggagcgagatcttgtaaaagaaattatcctgtgccatgaaatgtaccactattttgagatgttccgctggggaaggacgggggattccttcaaacgtaaggtgaagctgttccagatgattcctgtgacaagacggattctcccggcagaggaaattgctgcaaatgcatttacgaaagcatatttaaaactggagtttgaacctcaggaactggagcagatttattttaaccggatcaagtaagtccggtaaagcgaggcacgttgtgagcaagtaacggagcggattgtgaatatccgcttgacaggtgctgcagaatagagcggcatatgttttaaatcaggcacagagttacatgggctgtaagatgttcaggtgtgaaaaaaggactgaataattgatatataccgtcctttaatattacaggtttatgacacagatctaaaaaggggtaaacggtaccctgatagtaagacacagaaaaaagctgtgttgaactattagggtatcgtttacctctttaggttatctcattttttactttatggtttgtgttacatatacacaaataaaaataaacaactgcattatttggaaataaaaataaacgaatattgagcacattaataattttttttgtttatttttcatatatgtctgttcgtatataatggacacaacagctggacgataattgttgctgtatccagttgtaatttgataattttgtgaaatatcaaaaattaggaaaggagtacatgacacatgattgatgagacacaagttcaacaaccgctgttgttccaggacaatcggattgaacgattttacatcggcgggaaactgctgaatgagtggcggaaggctgaggcgggtgaagatacccatatgtgtgaggaactgcttgtcacatccatcggcgcaatttccaagggaaaggaggagggatttgcagtcagcagaacaatagaggaacaaggagcgctgctgttaagcgatattatccgggagtatccggaggaagtgctgggaaaaagatttcataaatataatcccagtcaattgacagttctggcacgggcgggagatactaaggtcagactggtgatgcagtgccacccaaagcgggaggatgccagaagatttttccagatgcacatgggtaagagcgaggcatggtacattgcaggaaccagagaagaggaacataacttatgcgtatatgccggctttaaacctcatgtgaccaggcagctttgggcggatttaatcgaaaagcaggatgttccgaagatgcttgactgcctgcaccagataccggtcaggcggggacagacaattttaattccggcgggaatggtgcattgtgtgggaccaggctgtttgttcctggaataccatgagtgtaacgatgtaacggtcagagtggagcgaaacattaatcagatgacgctgagcgatgaagagatgttttgcggactcagcacggacgacggcctcagtttgtttgactacacaacctatacagatgaacagatcgtccataaggttattatgaaggaacgcattattgagaagcaggaacaatacatcataacggatttgatcaatgaatcggacaatgattcattcggcatacagcttgccgaactcaacggaacttacgttctgccggagtttgacggacacaggattctgattccggtggaacatgatctgatactaagagagggtgataaagcattccggctggtgcagggacatgcggccctgatacctgcggcatgtaaagatttgaggctggaaggaaagggctgtaaggtaaccattggaataccatttatctcggagaaggagaatttgtgaatgaaaattgttggggtagcagcatgtactgcaggaatcgcgcatacttacattgccagagaaaagctggtaaagagcgcacagcttcgcgggcataccattgcttgtgagacacagggaaatatcggcatagagaatgaactggatccgaaggctattgcagatgcagatgtggtcattctggcagttgacgtggcgattgataaggcggagcgctttgaagggaaaaaagttatcaaggtagatacttcgacattgattaaaaatcccatcgggtttatgcagaaagtggaaaaagtgattgataaatagggggagcactatgaaggatatcattaacttgaaggaattgaagcagcacatattgaccggtatttcttattttattccgctggtggtcggtgcaggtttgacgatggcaatcggaagggcgttggcgggacagtcggttgcgaatctcggcgagaatggtattgggtactggatgttccagaccggatctttgggcatgcagatgatgacaccaatcttttgtgcctacattgccttttccataagcggcaagccgggactggcaccgggctttatcatcggctggctggcccacaacattaataccggctttatcggcggtatggtgggcggtgttctggtcggtgtcgtagtgaacttatgccggaaatatattaaattgccgaagacgattgaagctttaaggggaatgctgctcataccgtttttagctacggctgtgtcggggatgttgatgtttgctgttataaaagggccgattgtctggctgatggcaacaatgaccgcttttttacaatccttatcatccggttccaagtttctttatggcggtatgctgggagcgatggcaacctttgattttggcggaccggttaataaaactgcgaccgcatttgtcaatgctctttatgcggagggaatccgtgatgccaagaccgtccaaattatcgccagtatgattcagccgctgggaatttcactctcttgcctgatgatgagaaataaatacaccagacaggaaaaggagacattaaaagccgcctccatcatgggctgctttatgatttcagaaggtgtgataccgattgcagcgcgcgatctgctgcgggtagtgaccgcctgtgtctgcggttcttttgtggcaggcgggctctccatggtatggggaaattcttccgagctgttaaatggcgggtttatcgccttcccattcttttcatcgccggttcaaggacttctctcactggggagcggtgtagttatcacagcagcagttctttcgataataaagaaaccggttactgaggcagatgaaaatcgaaatgaggatttgggaaaagaactttcagatgaagatctggacgaaattgaaattgaaattatataaacaggaggcattatgctatacaatttaaaggaaatgttaacagtagctaagttgaatcattttgctgttggcgcattcaatacttcggatctggctctggtgagggcagtagttgagcaggcggaggcgacaaatacacctgcgattctgcagtttgcaccaggggaatttaaatatgctactcctcatttcttccaatatgtgactcagaggctgaaagacagcaaagtggcctttgccttgcatctggatcatggaaagaccatggaagagtgcgtggaggcgatccgggccggattcacatccgtgatgtatgacggttccctgctggagctggctaagaataagcggcatacaaaagaaatcgtggattttgcccattggctgggtgtatctgtggaggcggaaatcggcaccatcggccaggtcagcggttcggatgagggcggagttacggatgttacttataccaatccggaggaagttgttgattttgtcggagcgaccggctgtgacgcgctggcgattgctatcggcactgcccacggcatttatcccaagggattgaagcccaaactgcagctggaactgctggcagagatcaataaagttgccaccgtgccgctggtgctgcacggtggcagcgataatccggatgaggagatcaggcaggcctgtgagatcggaattcaaaaagttaacatatcgagtgatattaagcaggttttttttgcaaaggttcatgaaatttatacaaacaccggtaattttatgccgccgcaggtctttaatccgaccattgaaacggtgaagtttacggttcaggaaaagatggatctatttggggcaactgggaaatcctatttatggtaggttgaaatcccaatgacacgatatcaggagtgaacgatgaaacaggtaaaagatagtatcttattacacaatatactattgctgctaagtgaaaatgaatacatatccgtatccaagattgcgtcggttctggagaccagcgacagcacgatccgtcgaaaaatagacgctcttaatgatacgctgaaggaatccgggtatggctgtatacagaaatcaccgcggaaaggtctgcatctggtggtaaaaaacagcaatgcgattccgaaactgttttccagttttggttcgggaagtatcgcaaccgggagacagcaaattgataattacctgtttctgctgctatcgtcgaaggataaccggctgaccttaaatgagttaagtgaacaggtatatgattccattccagtggtcagaaagaatttgaaggtctgtgaagagtggctggcagtgtttgaactccggcttaatttccggcggaattatgggatttttttaacaggaagcgaagaaaatatccggctggcaatcaaacatctggtgctgaataacggattgtacagcattgatgaggccatcagcttttttgccagagggcttgacttagctttgttaaaaaaatgtattttcacgatgaaggacaagtgggacttgaagtttgctgaagagtcctttcattccctgcttatttacgcgacgctggccattgtccgcggccggtttggattactgaatatttcggaggcagaccgggatacaatccccaggtatgaagagtataactggtcaaaatccttgtttttgatgattgaggaaaagttttttgttaagatcagtgaggaagaaaccatctacttttccatccaactgctgtgttcttatctgatacacggcggaggggcagaggaaaataccgcttacgagtacgacgaaaaactgaagatatttattacccgtattgttgaagtgatcagtgaagtgctgagtatggacttgaccagggacagggaattatattatgggcttttaaatcacatccggccggccatattccggatgcggtttgagaaaaagacgaccaagacactgagtgactttatcaaggaagagtataaacagatgtatcgggtatcatgggccttgtcaattctgtttgaagagtgctatggcattaatatctcttcaacggaattaagctatattgctttgtattttcaggcttcccttgaacggctgtccaatccggtgagcatggcgctggtcacgaacctggggatgggattaaatcagctgtttgcaaacaagatcaggatttcaattccgaaggtggagacgattgcaattatttccttgcatgattttgaacgctctatgctgcagcaatatgatctgattgtctcaacgtcggatttaggcgttgtcagtaataatgttctgcaagtcggttcgccgctggcggataaggaaataggggagatccagcaccggattgaaatccttaataatcacaaattaaaaacaaaaatgaagtttgatccgtcctgtcatgatttatttgatccgcagttgatttttacggatgtgaaagtcagggacaaagaggaattgctgaagctgctgtctgatcgtctggtttcgctgggtcatgtgaccgcagactatcacgaatccatcttaaaacgggaaaagacagtgtccacctgtatcgggaatggggttgccattccccacgggaattctggatttgccaatcactccaaggtggcagtggcactcctagacagtccgttggaatggaatatggaaaacgctgtggatacagtatttctcctggcgtttaaggttgaaaaccgggatgactcgaagctgatccagctcttttacaagggctttctggagctgatcgagaccgagagcagccttggctatctacggagtctggaccgggatgagctttatcaatatttgattcaatagaggtgaatgatgcagcttaaagatgtacttgatgaaagaattatacgtattggcctggatgtaaaggataaaaatgaggcattaaacagattatcgcagcttttatatgaaaatcattacatcgataatgtcgatgaatttgtaaaagatatttatctgcgtgaggcggagggagtcacgggaattgggggaggaattgccattccccatggtaagagcctgagcgctaagcagccgggaattgcaattgcgactttgaaggcaccgattcagtgggagactttggatgagggagatgtggataccattttcctgttctgtgtcaatgcggacaaggattttggaagaaatcacatgcttttgctgtctaaggttgcggcgaagcttgcggatgatgaactgatacataagattcggaaggtttcctcctgtaaagagatgatctcttatctgacaggggagaagatatgaaggcaatgatgggatttcagaaaggatatgataaacgctatgtgcaataattatgaaagggatgacagcgttctgaagaaaatggcgatggagatccgactgctggccctggaagggattcatgcggcgggaagcggtcatacgggcggttcgctgtctgtggctgagattctttcggtgctgttatttcatgatatgcaggtgaatttaaagcagcctgaggaccctgatcgagatcggctggtgctctctaaggggcacgcggcgccggcttattatgcggctctggcattaaaaggatttttcccgaaggaggatatgaaaggactgcggcaggtaggaagtcatcttcagggccatccttccatggtgaagaccaagggcgtggatatgtccacggggtctctgggacagggactttcggcagcaaatggaatggcaatggctggaaagtatcatggaaaagattatactgtttattgtatctgcggagacggggaattgcaggaagggcagatttgggaggcggcgatgacttccgcgcattataagctggataatctggttttgtttgtggatcacaatcatttgcagattgacggccggacagaggaagtgatgaacgttgaaccaattggtgaaaagtttcaggcgtttggctgggatgtggacgagattgacgggcatgatgtgaaagcgataaaggcggcggtaactgcggcaaaaggccggaaaggtgtgccatcagtgattgtttgcaataccgtgaagggaaaaggcgtgtcatttatggagaatcaggctgtctggcatgggctttccccggatgatgaccaatatgagcgggcagtcatggaattaacggcaatggagacggagaaggaacggaggtcggcagagtgatgggatatttgtcaacgcgggaggcctatggggaggcgctggctgtgctggggcaggaacgggagttcgtggtacttgatgcagatttgtccaaggcaacgcagacgatacgatttgcgaagcgttatccggaccgcttctttaatatgggaatcagtgagggagatatgatgtctgcagcagccggaattgcatcgactggggagtgcgtgtttgccagcacttttgcaatgtttgcagcagggcgggcttatgagcagattcggaattccattgcctatcccgggctgaacgtgaagatcggggccacccacggagggattctgatcggagaggatggagcatctcatcagtgcattgaagatatttcactgatgaggacgataccgggaatgacagtgatagtaccctgtgatgaatatagtgtgtttgaggcggtgaaagctgcgatggagatagacggaccggtttatttaagattcggcagaatgtcgtcacctccggtttacgcaaaagacacggttcggttcacggtagggaaaggcaatgtactccgggatggaaatgatgtggtgattatagccatcggtgatatggtatatgaagcgctggcagcggcacaaactctatccgaggatgggctgtctgcagcagtcattgatatggcgagtgtcaaaccgattgatcgggatttgattctgacctatgcgaaaaagatcggaaaagttgtgacggctgaggatcacagtgtgataggcgggcttggaagtgcggtggctgaagtgctggcggagaatgggaatgcaaaactgcaccgggttggagtacaggaccggttcgggtgttcggggaagtctgcggatttgcagaataagttcagtttgaatgcttcagggattattatggcagtaaaggacttttaaaatcaatgacgccaagttgagaaatttaactgaatcaagtaagtccccacttcagatgtgaaaagcattaagtggtgggtgggaacttgtttgtgtcaggtagagtacaggctccacctgacaggcagcgacagctgctattgggttttgcccgataaagcggggcagggcctcccccccactatcggggacgccgtgagcaagtagcgaagcggattgcggactctttggagtccgttttttttatttggcataaaaatggtgctgctgctccagtagatttaatctacttttgcaacagctccttttcggttgaagcccattattgttcccctccgattccaacattttgtaaagtaagccctataacaccctgatcccttgggcagaagattccaatagtttttacttgcaaaatgaaataagatagagtagactaagttatattggaatatgttacattaacataatatactttgttttattaataaatttaactagaaggataaacattgcaggcatatggtattcggcaaattcctggctgcctgtaactacgaacacgcacatgtttatgaaaaatatatcaaaacaacagaaacggattttaaagtacaggaggaagcaggatgtattatgagatttgcacactgagttgtcttatggaaaaaccaatgcatggctatgaacttgggaaaaccttaaaaaggaatttcagcgcctgcacacgcataagcaacaataccatttatcccattctgaaaaaatttcagaagtctggttacatcatgaaacgagaagaacagcaggaaggaaaacctgaccggtttgtttatgaaattacggaggcgggtaaaagaagctttattcaaacgctcaatacgataacggatacacttgcctttgatcgtgaagaatttttcatccgggtttctttctttcacctgctgacgcctgacatccgcagaaaagttctggaaggcaggcttgcatttatacaggaggcgatgcttaccacaaggacgctgcaggatggagaaagcctatacggtcatcggtcggcggagggacgggaatttttattggaattgtaccgtttagagatggagactattgccaaatttcaatgccggattgacgagccatgtttggctccgaaagaatattttttttaaagaaaggacaatgatattatgtttaacagtttgctacaaccaggtaatatcggaaacgtcacacttcaaaacaggatgattatgcctgcaatgggcagcgggcacggcggaatggatggctccgtcaccgacgatctcattgaatactttgttgcacgggcaaaaggaggctttggcctggtcatcaccgagtatgcatttgttgatcccccagggaaagccaatccgggccagcttgctatttattcggatgaattcatacccggctgcaggcggctgaccgatcgcattcacagggagggaggcaaaatctttattcagcttcatcatgcgggcaggcaaacaatgaagcaaaccacgggtatgcagccggtggcgccttcggcgattccctgtccgatgttgggcggccagccacgggaactcaccacggaagaggtctacggtctgattgagaaattcggtgatgctgcggtgcgtgcgcaagaggccggatttgacggagtggagcttcacgcggcacacggatatttgattgcgcaatttctatcctcttatgtgaataaacggacggatgaatttggcggtgacttgatgggccgggcgcgttttgcagcggaaattattcaaaacatcaagaaaaagtgcggtgatttccccgtaagcgtccgcatcagcggagaagaattagtggaaggcggacggcagattaacgagacgaaagtgttggctaaacttctggaacgcagcggtgcagatgcgcttcatatctcacttggcacctatgccgtgatgccttatatggttccgcccagcaatgtacccattggctttattaccaaatatgctgaagcagtcaaaaaatctgttaaaatccccgtcattacagtaggccgtattaacgatccggtgcttgccgattccctcattgaggatgggattgcggattttgtttcacttggacgtgcttcccttgctgatgcggagtttcctctgaaggtacaggaaaatcgaatcgacgagatttctccatgtgtaggctgcctgacacgctgcaatggcactccaggtattttaccgggagatcatggcgtctcctgtatgctaaatccgttttccggccacgaaagcagtctgaatatcgaagcagccaattcccccaagaacgtggttattgtcggcgcgggcgttggcggactggaggccgcttgggtcgccgccgccagaggtcaccatgtggtagtgctggagaaagcaggaaaagccggcgggcaggttctgcccggctgcatgccgccaaataagagtgaacttgcgcgcggtatcaaatactatctgataatgtgcaggaagtacggcgtggagatacgttacaataccgaggccaccacggaaagcatcttggcatgcaaaccggatatcgtgatactggcaacgggggcaacacccatctggccgaatatccccaacgaaggaatccgggtgacgcaggcaaatgatattctgaacggaaatgcgcagatgggttacaacaacctcgtggtcggtggcggtatggtcgggctggaaactgcggaattccttctttcggagaaccgcagagcgaccgtggtagagatgctggacaaagccggtacggatatgaacgggagtgtggcattctttgtgttcaagactctgcgtgaaagcggggtggaaattatgacaggtaccaaggtggaacagttcaccaaagacggtgttgtctgttctgggaaagatggtgaacttcacctttccggtttcgacaatgtgattttggcaattggttccagggcttacaatccactggaagagagtcttaaaggtaaggtgcctgacctgcacgtgatcggtgacgcggtacagccgaggcggatcgcggcagccgtagaagaagctgcgcggcttgcggtaagcatttagaatgtgttatgggttaatgagtgcataaataggaagaagggatgcagatattcaactgcatccctttcattttatataaacattgtgagttacttggaatacttatttcatttgcatgaagtacgccaaaggcataatcaatttctataagactggaagtgacatctggcagtggtaaaaatcctgaaaggccgacgtggtttagatattaagaaattgcctccgtgcctaattccggcagcaaccgtaaaatagaattataccgaagttataatataaaatgaataataaaacggaagaaaagtaattaaaaacagaaaaaatacaggaaaagagaaaaatgaaacactttttattgacaagaaaaaggtaaaagaataaaatgtgacttaaaattaaataaagccgcagaaagcaggcattccatatataaaataacaaaccggaaatatgggcggagactccggaatgggaattctgccaagctttataactaaaaagtttttctaattcttttgcaaaggggcaacgtcctatatctgtaggaaacttgctccgaacctgatattcttacttcgtaaatccccagcagatacaggataaaaaatgaaatcatgtgattacggatacgtctgccgtattctttcgaatgcatgccaggatatgcgtcaatatctgcagacgggcggatcgccggccagtcttgaatctgggccatacaggcaaactgtttagataaataataagaagaatcaggaggagaaaaattatgaaaagaaaaacgatggcattatggatggcgattataatgacggcagcgctgatgaccggatgcggcgcttctgcatctgcgacaactgcggcatcagagagtactacaaccgccgcacctgcagcagaagcagagaccaccgccgctgaagcatcgacagaagcggagaccactgctgctgcatcgggaaaaaaaacagaaatctatgcgttcatcgcagccagcttaaaaaacactatggagaaaatcaaagaagattacgaggcggatcatccggaagtgaccattatttacaatgcggacagttcgggaaccctgcagaagcagattgaagaaggggcagagtgtgatatatttttctccgcggcgaccaagcagatgaaagcgctggaggacggcggccttgtggtggatggctctgtgacggatctgctgaccaataagattgtactgatcaagcccgccggtatggagacaaaagtgaccggattcgataatatcaccgaagcctccagtcttgcactggccggggaggatgtgccggttggccagtatgcccgccagctgttcactaatatgggtatgctggataaggtgatagccatggaaatcaatgaaggagccaatgttacggctgtgcttactgcagtagctgagggaagcaatgaggttggtatcgtatatgccactgacgcggcatccatggctgacaaggtggagatcattgccgaagcagataacagccagatagaaccagcagtttatccggttggtctggtaaagaatgctgaagcggatgatacacaggcaaaggctgcagaagaatttaaaacttatttgactgcagatgaggtaccgttgggcctgtttgaagaagctggatttaagataagtaaataaaatatactaaagtaaccgggaaggggataagaattatgaaaatcagtgcaaggaaccagttaagaggaaaagtaatcagcattcatacaggagcagtcaatgccattgtaggaattgatatcggcggaggtaatattgtttcagcaaccgtatccctggcggcagttcaggacctgggactggaagcaggaaaagacgcttatgcaatcatcaaggccacttccgtaatggtaggcattgactaaaattatatatggaataaagtgccaaagggctgatctgaaaacgttatgaagagatggcctaaaacaagtatcatgaataagcccgcctgatggcgggcttatttactgcatcataatcacttcccggcatagctttttctctttcagaatgtgataaatggcatctttccattttcctcaatacaacttattttttttaaccggatggctctatttcgggtcataaagaaaaggctgactttgctttcaaaacaattataggatatgggtgacaggttttgatatcacgtgttacaatttccgacaaagaatacatatagaaagttacaggaaaataaaggaattgtacattctggcggaaaaagcggggatgctcaattttcattgaatggattaagaaaattcagcaggctgtgccagacgatggctatatttattccagacactttaagggggcaggtatttcaggcaaaggatattgaaagacatacttcccaggaacggtgcgccgtgatattggcagtggaaagccctgtaaagctgggtgaatttaggaagtatcttcttcgaaaagggattctccagtctgtggtgaataagattttctttgagaatgcacagaaattttaatattttatgaaaaagcacagaagccgtaagaaaactgcaggaataaggaggcagaagagatgattgtcaaaggcggaaccgtggttatggaagccagggaaaaaagagcggatatcagggtaaaagatggcgtaattgtggaaattaaagagaatataagcctggaggagggagaagaatccgtagacgcatccggatgtatggtgatgccgggaggaattgatgcccatacccattttgacatgccggcagcagagtgtaagacctccgatgattttttttcggaaccagagcggcaatcatgggggaaccacaaccatacttgattttgcagaatttcagaggggagagaggatgcaggatggcctggacctctggcatgagaaagcagacggccggtccttctgtgattttggattccatatgacagttccggaatggaaggaagggacaggagaacagatccgctccatgatccggcaggggatcacctcttttaaagcttatacggcttaccaggacagcataggggtccgtgacaaagagctgtatcctatgatggagtgtatcaaagagacgggagcgattctttgtgtgcattgtgaaaatggagaagtattggagtatctgcagaagaaatatttaaaaaagaatccagataatattcgcagccatccgttgtccagacctgatttggtggaaaaggaagctgtgtccagagtcattgattttgcggaaatgaccggtgccagggtctatattgtccatgtgagcacaggggaggcaaaacaggccataggccgggcaaaggaacggggggtgcacatttacggggagacgtgtcctcaatatcttcttctggatgaatcctgttatgaactgccggggtttgatagtgcaaaatatgtgctttcaccgcctttgcggaaaaaggataaccagcccgcattgtggcaggggcttagggaaggagtgctggatacggtttccacggatcattgttctttcttttataaaactcataaacaccttgggaaagggtattttaccagaattcccaacggaataccgggagttgagcaccgtatggaactgatgcttcattacggagagcagcaggggctgagtccgtggatgattgccagggcaacggctgaaaatccggccaggatttttgggctatacccccgcaagggagtgattggggtgggaagtgacggagatcttatggttgtaaaaacggatttcccacacatgatctctgcggatacccagaatcagcaagtggattatacgccctatgaaggcttttgggtgaaaaagaaaatcaggcatgtgttgctgagaggtcagattgttgtaaaggaagggaagcttgtacaggaggaaccaggaggaagatttttaaaaagagagatcagcagatagaaatgaggggatttccggatgtcgttgagttatttgaaaaagattcaggatacagttgtccagtatgggaaaatactgtctcaaatggtaaatatggatattgtaattgtggattccgattgcctgcggattgcgggaaccggattttttgagccggagatagatgtctatgtaggggagactgcatttgtctttaaccaggtcatgcgcaccaagcgtcagattgtggttgaaaatccgggagagcatccgctgtgtacggactgcccccgctgtcaccgctgcaatgaaacttatgagatatcagctcccattctgatggatgatatggtgatcggtgtgatcggaatggtgtgtatgactcaggagcagaaggaactgatccagcccaggcttaccatttatctggaatttctgcgccagatcgcgggccttgtggcatcagcggcaaaggaacatttagaatcagaacggaaccgtgcccttaacggcatgcttcatgagatggtcaaccgggtcagccagggcatcctggtgttagatggacataacaggatcacctctgccaatgaggaggcggaaaggcttttaaagctggaaaagtcagaagagctggaaaagtttgtgaaggtggaaatccaggagaccggagatgagatgaaccatcagaaggagtacaagcttttggtgaacggatccatctataccgtatttggcacctgttatcaggcgcaggtgggacaggctccttatgggaccatgctcatattccatgatattaaggtattgcaggatgaaatatatgaaatcacccagttaagcagcatcaaagctccggagcagctgatcggagacagtcagtccaccagacagttgaaggaatacattgaaaagattgcggatgcaggcaccacggtgttgatcacaggcgaaagcggaaccggaaaagaggtggctgcaacctccatctggagaaggggaaaacgaaacaaggagaggttcattacgattcattgcggggccattcccgacagcaccatggaatatgagctgtttggatatgtgaaaggcgctttttcgggagcagatcccaacggacgaatggggaaatttgagctggcaaacggaggaatcattttcctggatgaaatcggggacctgcccatccaccttcagggaaagctgctgcgggccattcaggagcatgtgataacaagagtcggatctaaccatgaaatccaggtggatgtgcgcatcattgcggcaaccaaccgggatttaaatgaaatgatccggcttagaaagtttcgccgggatttgtactaccgcctgaatgtgattcccattgtcatgacgccgctgcgagagaggacggaagaaatccctcaatttgtgcgccatttcagcgcccgttattgccggctgtttggtaaaaagctgaccaggatcgctcctgaggtcatggaatgcctgaaggaatatgactggccgggaaatgtgagggaattggaaaactgtgtggaattcatggtgagcatgatgggggaagacggggtaattgacctttccatggttggcagcgagctgaaagataagatggcccttccaggccgggaggtgggcattaccccgataaaggaactggaacgcagggaaataatccgtgctcttgattattacggttaccatacggagggaaaaaagctggcgtccgccagacttggcatggggatcgccactttgtaccggaagctggaggaatacgggattgcaggcataaaaaattaaaaaaattatttatgcaaaggctggaaatgaaattttcagccttttatcaatttgataaaaaataaattgctttataggtctgagaaaggggaattggatctgttatcaaattgataatttataattattgtatatttattcgaaaatacagattaaatatgcaaaaagtggaataaaatgggtaaatatacagggaatatacaaaaaaagtagttgacatttttttgccgattcgttatacttccattcaagaaaacacgtaacaaaaaaacgaaggcgttttgaatccattaggttcaaagcgcctctttctttttgccgtcagagagggtgttgttccatgaaaaaaaataaaatgactgcggtaaaagcctcctggctcatattgtcggcggatgaagtttatgagaatcatgggtttctcatagaagataacaggatttcctccgttgttcccaatgaacggatcacagggacctgggatgaggatggggtgctggactgcagagggaagattgtatgtccgggcttaatcaatgcacatatgcaccaatatggaattttatccagaggctttcctgttatgggaagtgtgacggacttcgatacatttctgggcaattactggtggccttatatggaggaccggattcgttttaaggctgtggagataacctcaagggcatcggcggcagagctcattcacagcggcgtgaccggattgtgcgataccctggaagccccgtattgtgaaccggatactctgatccggcagggggaaatactggaagagcttggaatccgcgggatcgtttccctggaaagcagccagcgcattgatgaagccaacggacagttttgtctttctgaaaatgccagggctgcgcaatattttaagaaaaagcagggattggtggaaggggcggtctgtacccatacaacatttacctgtaacgacggatttattcgccaggcaatggagctggcggaaggtatggacgtaatgtaccagtttcatttgtcggaaagccggcacgaaccggaaaaagcagcattcaggaacatgcggcccgcccagatttacggcagccttggagtccttggaccgagaaccctggcttcccagtgtgtgaagctggattcttcggaaatcagcctgctggccgaaaaaaaggtaaaaaccgtacatatgcccatcagcaactgcgaggtgggaggaggaattgctcccattgtatccatgctggaggcgggcctgacggtaggacttggaaccgatggatacatcaatgatttttttgccgtcatgaaggctgcttttttaatccataaggcggccctggaaaaaaccgaggtcatggctgcatcggaggtctttcgcatggctacggaatatggggccggatgtcttggctggaaaaggtgcggaaaattaacccccggtttttatcctgactttattgtcttaaaagatgagtttttaactcctgttacaagagaaaatatatttgaccagatcgtagttcacggaaaaagggattatgtggaccgggtggtggtaaacggcagaattctcgtcgataaaggaattcttctgaacatggatgaagagaaaattaacgcagagatgcgggaatttgcaaaggaattccgggagggagccgtatgaacacatcaatattcgggatagagctccagtccccttttatcgtaggatcagggcccttaagctataatgcggaaggcatgatccggcttcaccggaccggcgccggagcagtggtgactaaaaccatccgtctggaaaaggcagtaaacccggtgaaccatatggtccggtgtgaaaagcaggggctgatcaattgtgagaaatggtcggattatgactccggattctggcttgatggagagcttaaaaaggcggtggacgccggagtggtgtgcattgccagcgtaggacacactctggaggaaagctcacagattttagaacggctggaacatacaggagttcccatggtcgaactggtatcctatgacagaaaagaactggttcccatgatacgggatgcaaaaaagagagtatccattcctgttctatgcaagctgtcgcccaatgttcctgattttctggaaatggcggaggcctgtatggctgccggtgccgatggatttacggcatgtgattccatgggacctgcgttgagaattgatattgaaaccgggcagcctcttgtgggaggtacagacggatatggctgggtgaccggttcctccattcttccatttattgaacagaaaatctgtgaactgcggaaagtctgtcatttgcccattataggtctgggaggagtgatgaagtggcaggatggaattgaactggtcatggcaggagcggattatatcggtgtctgttccgcactgattatgaacggaccggaataccttttcaaactgcaaaaaggggtggaaggctatcttgccggccatggatttcagtctttaaaggaaatccggggaacggtccatcagtatcttccggaaccgcccggcacagattttcagatgggttttgaaaaatcccgctgcaccagatgcaatatgtgcataaaggcatgtgcttatgaggccaggggatttgacgaagaggggaatatgattttggatatggaacggtgccgggcctgcggcctgtgcctgaccatgtgtccagtaaaagcgattttcagaaacactccgtaaaatttaagaaacgaggacatgaactgatgctgagtgaagaaagaggaaatgcggttattgatctatgcagaaaactgatccgggtgagaagctattccggagaggaaaaggaagtctctgactgcttaaaggagttcatggagtcaaacggcttccatgaggtagcggtggaccggtatggaaacaccatcggacacataaagggaaaccgtccgggaaagaggattttatttgacggacacatggataccgtacccattacccgggaagaccagtggcaggcccctcccttaagtgctgacataaaggacgggaaaatttatggaagaggagcttcggatatgaaaggcgctctggcggccatggcctgtgcggcggctgattttgccagggactgtcaaaatgattttgccggagatatttatgtggcaggcgtggtccatgaagaatgctttgaaggtctggctgcaagagagatcagcgcttatgcagagccggattatgtggtgatcggcgaagcctcccagctaaacttaaaaataggccagagggggcgggcggaaattgtggtggaaaccttcggcgttccggcccattctgcaaatcctgagaaaggaaataatgcggtttatcagatggtgaaggtcattgaggccattaaggccttagagcctcctgagcatccggttcttggaaaaggaattctggagctgacggacatcaagtccagtccatatcccggagcctccgtagtgccggaatactgccgctccacctatgacaggcggcttctggtaggggaaaccagggaaagcgttctggaacccattcaaaagcttctggaagggctgatggaagaaaatccctggattcatgcaaaagtctcctatgccattggcagagaaatgtgctatacaggcaatcccatagaaggtgagcgcttctttccaggctggctgtatgagaaggacagcgattttgttcaggcggtttaccaggagcttcagacggcgggttatactcctgaaatcacccagtacaatttctgtaccaatggaagccattatgcaggggaagcgggaattaagaccctcgggcttggaccctcagaagaatgtctggctcataccatcagcgagtatgtggaaatacagcagttgaaaaaagctgcggactgttattacctgactatgaaggctttgcttgatgaaaccaaaaaaaatatttgacaattgggatttacatatggtattttacctgtaacgagggcgttaacagaaatgtttccgccctcgtttttttaattaaatacaggtagatttgttagccgtaaattacatcactgatgtaattcgtaaatccttatctcatttatccatttaatcagaatgccgtactctgttttcaggacggtctgaaaggataaatgcagtaaggattttttatttcatggagagaggaaatgggaatgaaaatattaaaatccatatcaaaaccaattttatccattgtgctggcgctgctcataggagctgttgtcatatttctggtaggggaggatcccggggaagtttatctggttatgcttgaaggctccttgggaactcagagagcaatcgccttgacactggttaaggccactaccttgatctttgtaggaatgagctatggctttgcctataaatgcggtctgatcaacatcggtattgaaggccagctttatatgggagcgttgtttgcggtctgtcctgcagtttttttaaagcttccgcccctgcttcacattcctctcagcctcttttgcggatttctgggaggagggttatggggaggcctggccggctttctgaaaaaccggtttggctccaatgagatgatcactacggtcatgctgaactatgcggccatttatttcacctcatatatggtgaacggtcccattcaggaagcaaaaggagcctaccctcagacggacagcatccagccgtcggcccaactgatgaacttaattcccaaaacccagttaaatatcggcctgctggtggctttactggccctggctgtatatttcctgttctggaggtacacctccaagggatacgaaatgagcatggtaggctccagcagcgaagtggcccgttatggtgggatttccgttaaaaagacagtattcctgtccatgttcgtggcagggggcctgggaggcctggccggctgtatggaggttatgggagttcagcacaagctgattgcaggactgtccgcgggctatggctttgacggcattgcagtttctctcctgggaaataacggagcggcaggaatcctgttttcttccattttgttcggagccctccgaagcggaggaaatgccattcagatgtttaccaagataccggttgctgtaatatacattttgcaggctttggtcatcctgttcgtggtggctgatgtgttcagaaagagacaaggaaggagataagcaatggaagaaatgttcggctttttgaaagttgtgatcaacacgtcaactccaattctgtttgcaacacttggaattctgctgatgcatttatccggcgttttaaacatcggcgcagaagggatgatgcttatgggagccttttccggaatggcagggacctatctgtttggaaatgtctggtacggcgccctgtttggaatggcgattacaggtcttatgggactggtgttcgcattttttaccataaccatgaaagcaaaccagaccgtagtaggcgttgcctttaacatactgtccatcggacttaccaccaccctgtaccggatgctgttcggcatcggcggctctacgccccaattgaccggattccgtccggctgccgcaggacttacacttccggtctatatggggatcggaacggttcttctgttaacgttctttctttataagacaaagccgggacttaagatccgggctgcgggggaaaatcccagggcagtggattccatgggcttaagtgtaccgggaatccggtatgccggcactgtagccggctccatgctgattggttttggcggcgtgtacttatctatgggaatcctgtcctttttttcagaagaaatggtaacaggacggggctacattgccctggcggcggtgatcttcggccggtatacggcagtgggttccctgcttgcagttttggttttcggtgtgggagaggcttttgtttaccgtctccaggcaattggaagcgggatacccacccagtttattttgatgattccgtatgtacttacggttatcatagtagccggattcggaaaaaaatcaaacgaaccggaggctcttggccagccttatgaaaaggccaggtaaccagtttttcacacgaagcaggaggagaaaaaatgatgaagaaatctatgtttttcaaagtgaccgcaatggcggcagcagccctgatgagcctttccatggccggctgcgcaggaagtacaggaagctccgcagacagccagaccaccggagcagcttcccaggcagcatctactgaggcagcaaaaggcgaggctgggactacagccgcttcccaaatggctccggaagattataaagtggctttgctgcttccgggtacggtaaatgacaagggatggaaccaggaggcctatgaaggactggagcagattgaaaaagaaatcggctgtcaggtaacctattcagaaaaggttgctcctacggattatgaaaatgtattccggggctatgcggaccagggctttcatctgattatcggacatggatatgaatttgcggatgcggccatgaaggtagctcccgattatcctgattccatgttctgcattaccagtgcggatatataccaggagcccaatgtatgctctctggaaaacttaaatggtgagcagggatttttagccggagcggtagcagccatggccaccaaaagcggtgtagtaggttctgtcggcggaatggaagtgccctcaatcgtttattttaaccagggctttgtacagggagctgcctatgtaaatccggaggtaaaggctctgaccgcctttacgggagactttgatgacgcggcaaaggtaaaggaacaggcaaatgcatttatccagcagggagctgatgtgatcacccatgatgccgatgctgcaggacttggaatttttgaatctgcaaaggaacatgatggggtatataccattggttcggtaggcgaccagtacgagcttcttcctgaaaagaccctgaccagcgcaacgaaccagatcagcaaggcaatccttctggctgccacatatcaggttgcaggagagttagaacccatttcctataaattcggtataaaggaagaggtaatcggcctggcagatttccgggatttaaaatctgtctttacagaagagcagttaacggaactggaagaaatacagaaacggattgtaaacggtgaaatcaaaattgaggtttctgcacagtaattcatagttgaggagaatagtatgatgaaaaaatctatgatttctaaagtgtccgcagtggcagcagcagccctaatgaccgtttcactggctggctgcgcaggaagtacgggaagcacggtaaccagtgctccacctgaaacaaccccttccgtaacggaaacctccgctgaggccgaggcttccgcctcttcccagacagatgcaaaagattatgaggtagctttgctgcttccgggtacggtaaatgataagggctggaaccaggaggcctatgaaggccttcagatgattgaaaaggaaaccggctgccagacagcctattcagaaaaggttgctgcaacagaatatgaaaatgtgttccggggctatgcggatcagggctttaacctgattatcggccatggatatcaatttgcagatgcggccatgaaggtggctcccgattatcctgactccatgttctgtataaccagtgcagatgtgtatcaggagcctaatgtgtgctctctggaaaacttaaatggagagcagggatttttagccggagtggtagcggccatggctacaaaaagcggagtggtggcttccgtcggtggtctggagattcccgcaattgtttatttcaaccagggctttgtacagggagcagcctatgtaaatccggatataaaggctctgacagctcttaccggaaactttgatgatgcggcaaaagtaaaggaacagacaaacgcatttatccagcagggggccgatgtgatcacccatgacgccaatgctgcagggcttggaatttttgaagccataagggaaactaatggaatatacgccattggttccatacaagatcaatatgatctgcttcctgaaaagactctgaccagtgccactaatcgcatcagcaaggcaattcttctggctgcccagtatcagcttgccggagatttagaaccggtgtcttataagttcggtgtgaaggaaggggtaattggcctgtctgatttccgggaattgaagtcagtgtttacagaggaacagttaacggaaattgaggaaataaagaaaaagatttcaaatgatgaaatcgaagtagaggtttctttacaataaccggaagttacggagggacggatcatggcgccattattggaattaaggaacatttcaaaatacttttttggtttttgtgccaatcatgaaattaatctgacggtggaagcgggaaaggtatatggcctgctgggagagaatggggccggaaaaagcaccctgatgaacattctctatgggctggagcagccggatgagggaaccatttatatagatggaaaacaggaaaggatatcctccctaagacggcaatcagcagaggaatcggcatggtccatcagcatttcatgctgattccggccctgactgtgacggaaaatgtgatcctggccatggatgaaaacagacatctgcttctggataaaaaaacagtggccaaccgtatcatggagctgtcgaaacggtatcatctccagattgacccttacgccaaggtggaggatttaaccgtaggacagcagcagagggtggaaatattaaaggcaatttacaaggactgccgcctgctgattctggatgaacctacggcagttctcactccaaaggaaatcgaagagctttgcggcatgatccgtcactttaaaaaggaacagaaatcagttattttcatcactcataagctgaatgaggtcatgcgggtcagcgattccatctgtgtgctgcggagcggggaaaaggttgctgaggtcctgccggagtccaccagccagccggagctggcggccctcatggttggaaaggcagtgacattccgggttgaaaaggaaaaacggactcccggcaaagaggtgctttccgtcagccatctgggagtaaaccataggaacggccgccgtgctgtagacgatttgtccttaagggtgcgggaaggtgagatttacggaatcatcggcgtggatggaaacggccagccggagttggtacaggcaattacggccctgactaaaatcgagtcaggatcagtggaaatcctggggaaggatgtgacccgggcagagccaaagcaggtgctggactgcggagtatcccacattccggaagacaggcagcacatgggaatagccatgaaacggactgtaaccgataatctcctgctttataactataataacaaagaactgaaaaaaggaatttttctcgattggaaaaagctgggatggtttgcagaggacatggtgaaaaaatataatgtcaaggtgcctgatctgcagatgcagatcggatatctttccgggggaaaccagcagaaggctgtagtggcccgggagatggaaaaggagcctaagcttcttctggcagttcatcccaccagaggagtggatataggagccattgaatttatccataagcagattgtagcggccaggaacctgggctgtgccgtgcttcttgtttccacggaactggaggaggtattgtccttaagcgaccggataggcgttatttatgaaggaaagattttgggagaaatggaccagagcgatgcggacattgagaaaatcggtctgctgatggccggttcggcagaggagcaaaggacaggagcgtaaatatggataagatggatttattattgacccatgtaacaattgtaaccgtagacagccaccgccgggtgctctatgacggagccatggcggtgaagaaaggaagaattgccaaggtaggagagacagaggaaattctgagtgagtatcctgaggcagaacggattttagactgccggggcaagattctcttccccggttttatcaacacccataatcatttattccagactcttttaaagggtctgggagacgatatggtgctcagtgactggttaaagaccatgacctttcctgcagcccgttttcttacgcctgaggactgttattacggggcaatgcttggctgtatggaaggaatccactgcggaatcaccacaatggtggattatatgtacccccatgcggttcccggcttaagcgacggagtgctggaggcattttcccagatgaagatcagagggattttcggacggggctgtatgaatgatggactggattttggagtctgtcccgaaatcatgcaggatgtttccactgtggaaaaggatctgatccgcatttttgacagcttccacaacaaggaaaacagcaaagtaaaggtgtggacggcacccgccgccctctggtctaattccggagacatgctccgcatgctttgggaggtgacggagagctaccagtccggcctgacggtacacgtatcggaaactccttttgaccgtatggctacagaggcccttcacggctgtgccggagtggactgtttggagaagtacggcataaccggtgaaaatgtgctgatggtacattgtgtgtatctgacggaatcggatatcagcaaggccgctcattacggcttaaaggtttctcataatccggtgagcaatatgtatctttcctccggtgtggctcccattccggatatgctgaaagcaggcgttgccgtaagcctgggagtggacggtgccgcaagcaataacgggcaggacatgatagagctgatgaagacggcagccctgctccagaaggtacatactctggaccctacggtcataactgctgaaaaagtactggagatggcaaccattgacggggcaagagctgttggaatggaagaggaaatcggctccctggaagcaggaaaaaaagcagattttattattttcaatccataccggtcccctaaggccgtaccggttcacaatccggtttccacccttgtctattcatctacaccggccaatattgaggcagtggccgtggacggggaatttttaatggaacagggaaagctgaccatgatggcggacgaggaagcggttttggcaaagggtcaagctcaagcggacagtctggcaaaacgggccggaatcaccaaccggggagccggacatttatggaataccctatagaaggagcggtacaatgacccagaagaaggaataccgggtaatcggtaaatcccatccaagggtagatgcaggagacaaggtaacgggccgggctctttatacggatgaccttcagatgaagggaatgctttttgccggctgtgtgtataccacccacccccatgccagagccaaagtcgatataaacgctgcaaaaagtatggagggagtagcctgtgtgctgaccatggaggatttcccaaagcccagaagctattgtgattattactactgcactgatacgccctgctttatgggagatgtgctggcagtggcggcggcagaggatgaggaaatattggaacaggctttaaaagcagtccgggtaacctatgaggatcttccggccgtattcactattgaagaagcccttaaagaggatgcgccccagatccgggaggacggggtgggactttctcaaggcgtgccggcaaaagaaaaaaagggaaatgtatttttaaattcctaccatcctcttcgcaaaggggatgtaaaggcaggatttgaggaatcacaaatcattctggagaggacataccggactcagatggtggaacacgcctacatagaaccggaatcggtgctgacctattccgatcctgacgacggaatgataaccattcactcctgttcccagcagggacatgcgccaagggaatttgtggcggatgccctaaaccttcccatgaactgcatccgcgctgtccaaaggacagtgggaggctccttcggcgggaaatttgaagtggtgggactgatgagcgcaagggcggctctcgtcaccttaaagacgggacggccctgcaagataaccctgaccagagaacagtccatagtggaaagcatgaagcgccatccatttctcagcaatatccgcatcggcgccttacgggacggaacaattctggcttatcaggccactcagattgaaaattgcggagcctataacagccaggccccctggatgaatatccgtgccatggcccattccgcaggtccttatgaaattcccaacatccggaccgatacctacggagtgttcaccaacaatatgcatcccggcgcattccggggatacagctctcctcagatcatcttttccaatgagatgataattgacgaactggccgatgccctgggtgtggattccctggatattaaacgaaagaacctgctgcggcagggcagcctgaccgctacgggacaaactctctgccacaccacactgtttcccaaaatgatggaggatattgtaaggaatacggattatgagagaaaaaggaaggcttacaaaggccagacaggattgtggaaaaaaggaatcgggctggtgaccagctaccgcggctgcgctctgggaagtgaaggagtggatgccaccggagccatgtttaccgccttgccagacgggagctttctcctggatgcggctctgatggagattggtcagggccttaagaccgtttatctccagatcgctgcggaggccagtgggatttcccctgaccatattgccgtaaaatcagtggatacccacagtatcccggacagcggcttaactgtggcctccagagggactgctatgggcggacagtccgtcaaacaggcgggagaaaagatgaaagaaatgcttcttgaatcgggacggctcctgctggatgccaaagaagatgaaactgttgaaattgccggcagcatctgctttttggaggaagatccagggaggcggattcccgtatccaaaatctgcacgtaccgcagataccagggacttcctatggctgtttatgagtggtatattcccaggcccctgggaacggaagaagggacagggcagggggaggcctttacaacctatgcttatggcgtctgcgtggcagagacagccgtcaatgtcatgaccggacaggtgaaggtggaaaaaataacttcttatcatgatgtgggaaaggccattaaccctgacatgatacggggacagatatacggcggtattatgatggggatgggatttggactatgggaagagatccggctccacaaagggaagaccccggacttgaatctggattcctaccggctggggaccgccctggatgtgccggatatggatataaggctttatgaatgcgacgacccggaaggaacctatggcgcaaaatgcattgctgaggcggccacagaaatgattggggcggccctggccctgtcggtcaagcatgccattcaaaaaccggtccgcagcctgccggttaccatgaaacagattgcaggctttgaaatggaggctggagatggaaaataaaaaactgcttcaatttatatgcaatggaaaaacagaagccgtggccgtaaatggcagcgaacggctcattgatgttttgcgaaaaaaactgggacttacgggaaccaaggaaggctgcggtgtgggagaatgcggcgcctgtactgtgattgtagacggaaaagccgtaaattcctgtctggtccccgctgtttccattgagggccgtcaggtggtaacggtggaaggactgaaaaccgatgagggcctccaccctttacaggaggcattcatccgtcatcatgccgttcaatgcggtttttgttctccggggcttttaatgagcgccaaagccctgctggatgaggttccccatccaggccggaatgagataaagaatgccatcgccggaaacctatgccggtgcactggctatgagcaggtcattgaagcggttcttgacgcggcgaaccggaaggagtgaggacctatgttgtttgaaggctatgaaaaaatggtttcgctgaatgagataagcttaaggctgatgagcaggccttctcttctgtttgcaggaggaaccgatttgatggtaaaggccagagagaggggctggtatgaaaaaaagaccttcctggacatatcagagctgaaagagctgaaagagatccttgaaacagaagattttgtggaaatcggggcggcggtgacccttacagaactgctggaatcggaagacgttcagaaaagcctccctctcctttgccaggccgtttcccgggtcggatgcagacagatccgaaaccgggccactctggcgggcaatgtggcaaatgcctgtcctgcgtcagattgcattcctgctttgatggttctggatacaatcgctgttattcagggggtcaaaggatgccgggaaattttattgccggaattgttccgtgaaaccagaagctgccttcgccatgaggggatgcacgtaaagacctgcttttacggggagacgatggaaaagaaactgtttttagagggcggggaatggatccggtcggtcagaatcaggaagcagaaaaccggtgaaagaggattgttctataagctgaccaggaaccggtccagtgaactggccgttgtcaacatagctgcagcagtccggcagtcaggggcagggctgcaaataagaaccagcgtgggaggagtatttcctaaacccctgctttttcctgagtttgaagctgcatcagagaaaaaagaggaagcaccctgtgggtatacctttatgccaaagaacgtggcaaaaaaagaggaaacaaaagaaaagatccggcaatatgcggccgcatgcgcacaactgatggagccccttcaaaatgcactggtggattatccatataaaaaacaggtcgtaaaatatttaacagaagcagtgcttttagaactgcttttggggattcccatggaagaccgggaggagtgagccttatggaaataataggattacaggtaaacggtatttttaaggaaatagcggtggaaccaaaccagactttattaaagaccctgcgaaaggtgctgaagctgacaggaacgaaatgcggctgtgagaccggggactgcggagcctgtatggttttgattgacggagaagcagtccgttcctgcctggtgaaaacctcaaagctttccggaaaacaggtggtgaccattgaaggcattacgggggaaatgagaaaaaacggtgacctgcatcccattcagcaggcatttgtggaggccggagcggtccaatgcgggttctgcactcctggaatgattatttcagcaaaggcgctgctggataaaaaccctgatccaagccgggaggaagtgatacaagccattgataaaaatttgtgccggtgtaccggttacgtaaaaattgctgatgcggttttactggctgccaagaagatgggagggaaagaaaatgaagtcacagaaagcgccgggaggtgtgggagcttccagacccatccgggatgcgcaggagaaggtatcaggtcagaagctgtatgtggctgacatggagtttccggggatgctttatggaaagatgcttctaagccccattgcccatggaaaaatccgttctatagataccagggaagcggaagcacttccaggagtatacgctgtggcaaccttccgtaacacacctgggacatcctttaacagcgcaaagcgtctgatcgagcagcaggtaatctgcaatgaaaagatctttgatgatacggtccgttttgtgggggaccgggtggctgcagtggctgcagagacggaaagcatcgcaaaggaggccattaagcggatcaaggtggagtatgaagaacttcccgtgattctcagtgcagaggaggccgccggggaaggacagtaccccatccatccgggcggaaatattgccggaaaggtagaggtttccgccggagacccggaagccgcctttttacaatgtgattatgttctggaaggaaagtattccacacaggccgtacaccatggggcaatagaaccccatgtggccattgcggactggaatgcaagaggccatttgacggtatacagtcccaatcagaacagctttgccttccgcatcatactttccgaaattttcggaatcagctataacaggatacgtgtaattgtgcctgcaatcggggagctttcggaggcaagctggaggtgacggtggagcctgtggcagccattttgagcaaaatgtcagggcgcccggtcaaggtcgagcttgaccgcagggaaaccatactggcaagcaggttgcggcatccatccctcacttatatcaaaaccgggtttatgaaggatgggattttaaaggcagtggattttaagatgtatatcaacacaggagcttatgcttccagcgccatgaatgtggccggcgcattgagccataaagtgttcatggcctataaatccccccatatgcacattgagatttacccggtttataccaataccattgtttcaggagccatgcggggatatgggtcgccccaggtgtatttcggtttccagcgccagatgcataaaatagcaaaatttcttcacatggatgaagcaaagctgcagcaaataaatatggtggatcctgacggcaaaaatccggtccatcatcatcccctgggaaatccaagacctaaggactgccttcaaaaactgcttgagctgatggattattcaaagcttttaaaggagcaggagcagagcaggaaggaggggggaagataccgcattggcataggaatagccatgggagtacacgggaacaactgctttggcgcacatcgggataccaccagtccaatgatccggatgaacgaagacgggagctgcattttgtataccggagcccatgatatgggaaatgacagcgtgggaatgcaggtgcagatattatcccaggtcctgggcatttccctggaccgcatcgaggtggtagcagcggatacggatggctgtcagtggcatatcggcgattattccagcaggggagtctatgtcatcggagcagcggctaagaaggcggcggaaaagatgaaggaagagcttcggaaggaagcggctaaggtcctggatgttttgccggatcagattgagcttcacgatgatgctgcatgggcttgtgacggcagcggaaattatgcttccctccgccaggtgatgatacactgccagagcgtaagcaagagagagctttgtgtgatggaaacctatcacgcttaccggggagcatcttcctacggggtacatctggcaaaggtgtctgtggaccggtcaaccggggagacgaaggtgctggattacggtgcagtccatgacgtgggccatgtagtgaatcccatgatgatagaaggacagcttgagggagccattctcatgggcctgggctatggtcttttggaagaaatccaatacgatgccaggggaattccttctcccctcacgttcagacgataccggatgcccagggcagggcaggtgccaaagctccatttgggctttgtggctgatatagatggaggcgagccgggagggccttacggcgcaaaaagtctgggagaaagtcctgtggtaccggtagcgcctgcgcttgtcaacgcaatctgcaatgcgctggaaattgagctggatgaacttcctgcatcaccggaacggataagggcggcgcttttggaaaaaggaaatgcttaaaaaaaggagatcaacatggtaaaaattttaggtatatgcggaagcccaaggaaaaaatctgcttttacggcactggaggcagccctggaggctgcaaggaattccggagaagccgttgagacagagctggtggagctgaggggaaagaagatcagcctgtgcatccactgcaaccagtgtttaaagcgccaggaggatcactgtaccgtctttaccgatgatatgacgcctttatatgaaaagttttatcaggcagatggcattatcatcgcatcaccggtttatgaaatgaatttgaccgctcagaccgccgcctttatgggacggttccgttccgcatggctgaaagggatacaggagccggagtttttcatgcacaaagtaggagccggaattgcagtaggaggcaccagaaacggagggcaggagtttaccatggcggcgatccagaactttttcctcactcagggaatcaccctgtgtgccgggggaagcgggatgtattccggccccatgctctggaatccgggagacggctccactgagatggacgataaaacgggcatggagctggtacggctgctgggtaagaaggtggcggtcatggccaggatcatgaaagaagctgagatccgatgagaagaaaaacggaaaagggaaccatagaaaagtaacgatagaaatggaagtggcagttcatggaagagattgtattgaatgtcaacagcagaaattatactattttatcagaaaaaaactggactcttctgtatgtgctgcgggagatcctgggactgaccggaaccaaatgcgggtgcggaacaaacgactgcggcgcctgccgggtcatcattgacggagaggcggtaaactcttgcgcacgcctggcatggaagctggaaggaaagtccgttattaccattgaagggcttggaaacggacaaaagctccatcccatccagcaggcatttattgatgcaggagcggtacagtgcggattctgcacgccgggtatgattctgtcagctaaggcgttgttagataaaaatccagagcccctggaagatgagatacggactgcgctgcgggataatctctgccggtgtaccggttatgtaagaattgtggaagccgtaaaactggcagctgggcgaatgaaggagggggaccatgagggaggatgagtttcaaaacggagttctgggaaagagccatccggttttaaatgtaaattccaaggttacgggaaaccttctctatacaggagatatgaagctgccgggaatgctttatgcacaagtgctgttcagcccgtttgcccatgcaaaaatcaaatccattgatgtgtctgccgcagaagcgctggaaggggtacatggggttgtatgttaccgggattcacccaaagtgcgctacaatggaaatggggaggattcatcctttaagccgtcggagctggtttttgaagacgtggtccgttacgtgggggataaggtagctgccgttgcggcggaaactcccctgattgcggccagtgcaataaaactgatccaggtggaatatgagcccctgcccttttatttagatccggaagaagccctggcagaaggggcatgccccattcatgaaggaggaaacttaatggaagaggtttgtctttccggcggggatctggacaatggatttgccgaagcagaccgtatatttgagcagacctaccgggtgccgcctatccatcatgcagccttagagccccacgtttcgctggcagtttatgatcccgacggtaagctgacggtatatacgcccagccaggatgtgttcggacagaggctgaatttaagtaaaatattcagccttcccatgaaccgcatccgggtgttgaacccggcaatgggagggggattcgggggaaagatcgatctgattacagagcccgttgcagctcttttgtccatgaaatgcggcaggcccgtaaagctggtatacaccaggaggcaggatatttcgtcatccacaacccgccatggggagaccatttatatccgcacgggagtaaaagcagacggaaaggtaattgcctgcgactataaggtttatttaagtgccggagctcacagcggagccacctcaagcgtggcatgggcggcaggaggaaaattttttaagctttttgatattcccaatatgcgttaccgagcttatactgcatataccaactgttctgtagcaggagccatgagaggctttggttctcctcagttgttttatgcatttaacagccagttgaaccagatcgcaatgaaaatgcaatttgatctgccttccctgatgaaaaagaatttatttaatcccaatgatacggacctgcggggacagaatttgggaaattaccgcatcagggattgtctcttaagaggacttgagctttttggctggaaggatgcatggaaagagcagcaggagtcagggaaggccaagggacggtaccgtatcggggtgggtctggcagcaggccctcatgccagcagcctgttcggggtatttgccgataccaccggtgtcatgcttaaaatgaatgaggatggttcccttaccatctttaccggcgtcagtgatatgggaaacggctccaataccattcagatgatgctggtctcagaggtccttggaatttccatggaccggatcgcctgtgtgaaaacagatacggaactgaccctgtttgatgtgggagcctatgccagccggggtacctatgtcggcggaggagcagccttaaaggcagccagggaaatgaaagaaaaaattctcctggaggcgtctgaaatacttggctgtccagccagggagcttgtattgaggaataacggtgtatggatggctgatggaagcggtgcagggatttctatggacagaatcgctgcccatgctcacaatgagcatgaaaaggatctggttgcggcggtcaccttcggttctttagcagtacccatatccggcggtgttcatctggtaaaggtccaggtggatacaaagacaggagaggtgaagcctcttgcctacacggccgttcatgacgtggggaaggtgctgaatccggcctccgtagaaggacagcttcatggaggcattatgatgggacttggttatgccctgtcagaagaactttcatacgacgaaaaaggggccctgcgccagcgaaggctgggagactgcggcctgttccgggcagaccagatgcctgagatccagacagagtttctggacagctacgaatccacagggccatacggcgctaagagcataggagaatgtgctacggtgccttccgccgccgccgtagccaatgcagtctccaatgccctgggacatgaaatcacaaggcttcccatacgtccgaatgcggtcttagaggctatttatagtgaagcagttaaatgaattgaggacatttccgttttggaaatgtcctttttccctttataaatgagaagttaggggaggtgaaatgtccaagaaacttttttgatatagttccatttacaccacaatcgtcagaaaacaatatattactgttaaaaaatagtggaaacaagactttaatgagaaatttttttgtttattatgcaatattgaaatcaatgcggaaaaccaatatagttaatacaacctaagtagtcgacgaaacttcagggaaacacactgttacgatgtggtagcacagatatttatctgctggctaccttttttttatttaaaaggaggatgtgctatgagacaggttgctatctatggaaaaggcggaattgggaagtcaacaacaacacagaacttaacggcaggacttgcagagatgggaaaacacatcatgattgtaggatgcgaccctaaggcagactcaaccagactggtactgggcggtctggcacagaaaacggttcttgatacccttcgtgatgaaggagatgacattgaactggattcggtcatgaaggaaggctacggcggaatcaaaggtgtggagtcaggcggtccggaacctggcgttggctgtgcaggacgggggatcatcacttccatcaacttacttgagcagctgggagcttataccgatgatctggactatgtattttacgatgttctcggagatgttgtgtgcggaggttttgcgatgcccattcgggaaggcaaggcccaggagatctacatcgtatgttccggggagatgatggccctttatgcagccaataacatctctaaaggtattgcaaaatatgcaaagacagggggcgtccgtatgggcgggctgatctgtaactccagaaaggtagacagggaggaagatctggttcaggcagtggctgcaaagataggaacacagatgattcatttcgtaccccgtgacaatgcggtacaaagagcagagatccggaaacgtacggttatcgatttctcaccggaggagcctcaggcagatgagtaccggcagctggcccaaaaggttgacaacaatgagatgtttgtgattccaaaccccatgaagatcgaggaactggaagagattctgatgcaatatggcgtaatggactgatgatccggcagagaggagaacggctatgttattagtgagagcaatcgtaaggcctgaaaagtcagggtacgtgatgaaagaagcggcagaggctggatttcaggcggtgacaaagatggatgtatatggacggggcaagcagaaaggtatccaggttggtgacatctattatgatgagatcccaaaagaaatgctgctgtttttctgcaatgatgaagataaggacgatctggtaaaggtaattttaagaacggcaaaaaccggtgatggcaattttggtgacgggcgtatcttcatctctccggtagaggatgcttataccatcagcagcggaaaacaggggctttgatggagtttttcaggagaggagaaaagtgatgaaggaagtaatggcgtttatccgcaccaacaaggtaaatgtgacgaaaaaggctttagcggaaggtggttttccggcattcacctgcaggccggtgctgggcagagggaaaaaaagtattgatcccgagcttttatccattgtgatacagaatggagagctgcctctcaatatgtcgggtgaacatctgacggaggcattccgtttaattccaaagaggttttttaccttgattatggaagacagtgaagtaccaaaagctgtggagatcctgattaagaccaatcaaacgggcaatccgggagacggtaaaatatttgttcttcccatttatgaagcatatacggtcagaagcggtgagaagacggtagaggcttattaggaggcgaaatcatggcaaaagaaagagatgaattattggataaatactcggcgcgggtatttaaaaacagaaagaatcatatcacccagctggaatttggtgacgcccgggatgagattatggctaacacccgtgcaattccaggcatcgtaaccgcaagaggctgctgctacgcagggtgcaagggcgttgttgtcggaccgatgaaggatgctgtcgtgattacccatgggcccattggatgtgcattttattcatggggtaccagaaggaataaagcgaagtcttcctatgagggggaaccgaactttgtaccgtattctttctgtacagacatgaaggcgccggacatcgtattcggcggagaaaaaaagctggaggcaggaattgatgagatcatggacttgttcagccccaaatgtatctttatctgctccacctgtcccattggtctgatcggtgatgatgtgcaggcagtagcgcggcgggtggaggaaaaatacgggatcacggcagtcgggtattcctgtgaaggttataagggtgtatctcagtctgccggacatcatatcgcaaacaacggacttatgcgctatgtcatcggtaaaggcgaaaaggctccaaaaacaaagtacagcattaatatcttaggggaatacaacatcggcggtgatggctgggagcaggagcgggttttgaagaaaataggatatgaggtggtatcggtgttcaccggagacggttcctatgaaaccatgaaaaatgctcatttggcagacttgaatctggtcatgtgccaccgttccatcaactatattgcagaaatgatgaagacaaaatacggaatcgactggctgaaagtaaacttcatcggtgttggagccacctgcaagtctcttcgtatgatggcggagtatttcaatgacccggaactgacgaagcggacagaggaagtgattgcggaggagctggcagagatccaggaggatatggagtattataaatccaagctaaaggggaagacagccggtatcttcgtaggaggctccagatcccaccattatcagcttttattaaaggattttgggatagagaccaccatcgcaggatatgagtttgcccatagggatgactacgaaggccgggaaattattccccagattaaagcggatgctgattccaagaacattgaggaaatcaccgttgagcgggaagagggatatacggaccgctatacggaggaggaactggttaagctgcggtcagccggcgtggaactggatacctatgacggcatgattaaagatatgaagaaaggccatatggtagtggatgattacaacatgtttgaaactgaccagctgatcgaggaatataagcctgatatctttttttccggtatcaaagacaaatacgcaatccagcatggcggcgttgtatccagacagatgcattcttatgattattccggtccttatgcaggattccggggagctgttaatttcggcagggatgtgaccatgagcctgtataccaatgcatgggcgctgataagtccgccctggaaaacagcccccatgctggaaggaagtttaggaggtggaaaataatgcttgatttaactccaaaagaaattatggagaaacgccatataaccataaatccatgtaagacctgcgagccggtgggagccatgttctgtgctctgggtgtggagaactgtatgccccactcccatggttcccagggctgctgttcctatcacagaacagtgctgagccgtcatttcaaagagcctgccctggcgtcttccagttcctttacagagggtgcttccgtatttggaggaagaagtaatatcaatacggcggtgaaaaatatttttgacctctatgatccggatatcatagccatacataccacctgcctgtcagagaccatcggtgatgacgtaggatcctatattctggatatggaaattccggatgataagaaagtactgtttgccagtactccatcctatgaaggctcccatattcagggcttctccaacatggtaatcggttttatgaagtacctgacgaaaaagacgggtacacccaacggaaaaacggcgatttttccaggctgggtcaatccgggggacgaccgggaattaaaaagaatcgcatctctcatgggagcagattacatctatttcccggatcatgacggtacgctggatcatcccatggatggaaaaaatgaatattttcatgcccatgcaggaacatccctggcggatatggaggctttgggcgactgcgtaaagctgatttccatgggaacctactgcagccaggaaccttcggattatatgaaacggcagttcgctacgccttatgccaatattcctcttcccgtgggggtggcgctgacagatcgctacgtgacagagcttcggaaggtgacaaagcaggaggtgccaaaggtattggaggatgagagaggacgattacttgacctgatgctggattcccatcagtacacctataaaaagaaggtggccatttatggagatccggatattgtttacgcatttacgtctctttgtctggaacttagcatgtgtcctaaatacattatcacaggcacaccaaaggaaagctgggtaaaagagatcagggcgctgatgagccagtatggggtggatgagtcggagtatgtggtaaaagcagatacggacttgttttatctgcaccagctgatcaaaaatgaaggcgtagacctgcttttgggatccagctacggcaaacagatcgcaaaggcggaagatattcccatggtcagaatgggatttccggtgcttgaccggtatggcaatccaattcaggcctccgtcggttacgcaggcgggatacggtatgtggagaaaatcgtggatgccatgatggaccggcaggaccgggatgctctggatgaggattttgatgttgtcatgtagggttatagcagcagatacaactacatagcaactgggagggaggacccctccctattgctgtatcagagaggagcggttgaatgggaaatatactggatgccaggaaaagttctattttgtttaaagatgactgcagcggacagagaagcggaatctgctgtgacagtgacagtgtatcaggtgcggtatctcaaagagcctgcgtctactgcggcgcccgtgtggtattgaatccgattacggatgcttaccatatcatacacggccccatcggctgttccagctatacatgggatatccgcggttctctgaccagcggggaggatatctaccgaaacagtttttccacggatttacaggagacggatatcatcttcggcggagtgagaaagctggaagccgcagtggatgaactgatgaaattccaccgggaagcaaagctgatttttatctatgcaacctgtattgtcggcgtaatcggggatgatgtggatgcggtatgccggatgaagtccgaacagtatcggataccggtgattccggtcaaatctccgggcttttcaggcagtaaatccaccggataccggatggcctgcgatgcaatcatggaagtcctgcgtccccataagacagaggtaaaacagaaagccattaacattctgggagattttaaccttgcaggagagatgtggatcatcaaaaattacttcaagaagatgggaatcgaagtgatctgcggatttaccggggatgcagactatgatgatatggtgaaagcgcctgaagcgtccttaaatattgtccagtgcgccggttccagtacctatcttgcccagcagatggaagaggagtttggaattccatatatgaaagtcagtttctttggcgtggaagatacaaccgcctccctgatccgggtggcagaagcccttggagatgaggcggccagggaaaaagcagttaagttttgctgggaagaaacggaaaagctgcaaagctttctggacaaatacacaaagagcttaaaaggaaagaaagcagctatctatgtaggcggcggatttaaagccatttccctgatacgccagtttgccgtagtgggaatccagacggtgctggtgggaacccagacagggaaaaaagaggaatatgaggtcattgaaagcctggtggatcaggatacggttatcctggatgatgccaatccggcggagcttgagacatttatgaaggaaaagggagcagatatcctggtgggaggtgtcaaggagcgcccgctggcctacaagctgggtgtggcattctgcgatcacaaccatgagagaaagcatcctctggcaggattcgaaggggtttataactttacgcgggagattaaccgcagtatgaataatccggtttgggaatatgtgaaagtcctttgaaaaactggcggcggaaaggtggtatggttatgaaaagtgaagtaaaaccgcttgtaaatatgaacgttaacccatgtaagatgtgcatgcccatggggagtgcaacagcattttacggagtaaaaaaatgcatgacaatccttcatggctcacaggggtgtgcaacatacataagacgccatatggcgacccattacaatgagccggtggatatcgcttcttcatccctgacggagcagggaacggtttacggaggaagcgcaaatttgaaaaagggactgaagaatctgatagaactgtatcatccggatgtcatcggtgtgatgaccacctgtctggcggaaacgatcggagaggatgttccggggatcatcgataatttttatgaagaaaatccggaataccgggatattcatatcatcccctgccaatcaccgggatatggcggaagtcagtatgaaggatattttgaagcgctgtatgccattgtattatccgtaaagatggaagctgataaaaatgacagaatcaatgtggtgacggctcctttaagtccggcggataccaggtatttaaaacaggtgttccggatgttcggactgaagccggttctcctgcctgacatctcagacaatctggatggaagccatgcaaaagagtataaccgtctcccccagggcggcactgatataggggagatccggaaaatgggcggtgcaaggatgacactggaactgagcgggctgacacataaacactctgtgggcgatctgcttctggaaaaatatggagtgccttgcaaaaagctgaatctgccggtgggcctgcgggatacggatgctttttttcacgctttgtcagaacttgcagccattccggttccgaatgaaattaagtcggaacggggaagatatttggatgccatgattgattcccacaaatataattctgccggacgcgccgtggtattcggagaacctgatctggtgctttccacggtccgaatgatgtgcgaaagcggtgtcatgccggttgtatgtgctgccggctctgtctgtccggagctgaaaacactgctgttgccggaactgaaaaagctggcggatatgtactttgtggaagattataccgttgtagaccgggcagattttaaggatattggacagatggctgaaaagtaccatgccaatatgatggcaggaaattccgacggcaggagagttgccgaagaggaaaagctgccgctcatccgccgcggatttcccatccatgaccatgtaggcggacagcggctccggatgctggggtatgagggcagcatggaatacttggatgaaatcaccaatgccctgattgatacgacagagacaacattccgtgaacagctttatgatacttattacaaaaactctctgattgataagaacggtccggcggcttctgccggggcggaatcggatctggatatcatggagaaaaagacaatggaacacccctgctacaactgcggcgctcataaatatgccagaattcatcttccggtagcaccggcctgtaacgtgcagtgcaattactgcgtgagaaaattcgactgccagaatgagagcaggcctggggttacttccaaaattctgactcccacagaggcacttgagcggtaccggctggtgaaggaaaaaatgccgaacttaacggtggcaggtatcgcagggcccggtgatgcccttgctaactgggaagaagtgagtgaaaccttccgtctgatcagggaatatgatcctgatgtgactttctgcctttctacaaatggactgctcctcccctggtatgcaaaggagctggcagaactgggggtatctcatgtgacagtgacgctgaatgcagtagatcctcatctcagcggccagatatataagtatatccggttcatgggccagaattatgaaggagatggggccggggccatcatggtgtccaatcagctggcaggaatccgtatgctggtggaaagccacatcattgttaaaatcaatatcgtaacagtacggggaatcaatgaagagcatataccggaaatcgtgaggaccgtaaaggatatggggtgttatatcactaatatcatgcagctgattccggtagaaggaagtatttttgagcacctggagccaattccattaaaacagattcaggagatccgcagggaatgtgaagcaattatgccccagatgtatcactgccagcactgcagagcggatgccgtggggaccctggatcatgaccaatccattgatttacgcggtgcagtgaaaccggtggaggaagctgcccgggacttatcagaaataacgaagccggcaaaggcggccgttcgtttcgcagtggcctccaaaagcggtatgattgtagatactcattttggccatgcaaaggaattctatatttatgattatgcagatggccaggtccgtttcattggaaggcgcagcgtggagcaatactgcaaaggtgtggaagaatgcggtgaaaaagaagatcatattcagaagattatcacggccctgtatggctgcaatggcgtcattgccatgaggatcggcgcagagcctaaggagaaactgaatcagaaaggaatcatggcggtcaatacctatgatgtgattgaggatgcggtaagaaaagcagcatccagcatgtaaaaaggaggagcaggatggtacagcccaaatatcatgtgtttatctgcacgagctgcagaatcaacggaactcagaaagggttttgttttcagaaaggaagcgttgatctggtgcagtcttttatgcaggaaattgaggacagggaactttccggtgaagtggttcttaacaataccggatgctttggaatctgtgacaaaggaccggttgttgtggtttatccggagggtgtctggtatgggaatgtgacaacagctgatgtggaacggattttcgatgaacattttgaaggagggaatccagtgaaagatctgatgatttaaattcccgaaaggagggaaaccgtatggttaggattatcgatgggacactgacgatgcttaatggatacatggtcactgctgctcaggcacagcgtttcctggagctgctgctggaagtcggaattgatgcggcggcggtttctcctgaaatatatgagcttttgggaggaaggatgccggaacggatgataagttacttagaacagatgggaatgcctgcagaatataaggaataccctggtgtccaaaatatcatttccacatactgcagcggcagaggaatccatattcggaattaccagattaatgaactggcagaattaagaggaattcccacagatgacccggagcggagattccggctgacaggcctggatgatttactgacctacgaaagcgaacggatttatgaaagggccatggaggagctggtaaagattgcacccatcctgtatccggagaacgcgtattactgcgcaacggccattgcggtcagttatctgcagcgtaataacagcgggacagtgatgacgacttttaccggaatcggcagcaaagctgcgactgaacaggtgattgctgccatgcgggtgatgcagcgccataaacccaaccaggatcttaccgggcttaaaaagcttcggcagttatttgaggagatgaccggcactgcggttgatgcccatgctcctgtgataggagaacggattttttatgtggagtctggtattcatgtggacggagtcctaaaaaagccttccaattatgaatcctatcctccggagctggtgggagcccgccgggaaatcgttctgggcaaacattccggaaaggcctctgtccggtataagctgaatgcgctggggcttgatgaggcagaatatgataaagccaggattcttggtcagattaaacgtcttagtataaagaaggggaaggatgtaacggaccaggaatttctggagattgcagggaggtgcaggaacaatgcgtaaggcggtcagtatggtggataccacgctccgggacggggagcagcgtccgggaatcaccttttccattgaggataaaatccgattggcagggcttcttgaccaggcgggagtctatgaaattgaagccggattttacgatgcagggatggaggggcgtgactatatccggagaatcatggaaaaacggaagaaagcgctggtttccgtatggtctctgttaaatcctgaatgtgttgagcaggctgcacggcagaagccggacttgattcatattggaaccccagtgtcatatgtccagatttaccataagcttaaaaagaacaaaaaatgggtggaaaggatgctccaggactgtatccaggtggcaaaggactatggtgtgggtgtaacagttggactggaggacgctaccagagccgatgtggcatttatgaatcatctgctccggacaatggaacagcagggcgtggaggctgtccggctggcggacacagttggaatcctgtctccccaaagggccagaaatatggtacgggaactgaaagaagtggttccgcttaaaatagagatacatgaacacaatgattttggaatggccgtagcgaattccattgtcatggcagcagcaggtgcggatatggttgatgccaccctgttcggaatcggagaacgggcaggcaactgcgatttgtaccagtttgtacatgcggcaggcagaaagtttgagctggatatgaagaaagcagagatcagacgggcggagatcctgttaaaagagatgatggcaggaggtaagaatcatgatacggcagatagcatatgaggaaaccggaagaaaaaagctggcaaaggggatccggaagctctgcggcctactggtctgtgacggcggaatccttgtgaatggctcttataccatgtcggcagcagagacagccaggtatatggaaggcgaggatctgtacatcaatcagggcattcggctggcagcgggaaccataggggaaatcaatgccagaaccggctgcggtacgaaagaggcggcttccatgctgctggtccagctgacagcctgtgaaaaggcggcggcctccgggatcaatcccgtttatctatcacaaaaaatcagagaagcagcagattggatggcggagatggcagaaaaggctgcggttcatgagtgggtccatctgaaggaggagctggttaagatcacggccgaggcagaactggctgaaatgattcttcaggcattggaagcaggcgaggtgataatcaaggattctgtgcaggtaaagaccagaatggaagtaataaagggaatgacagtcagcgggcagcttcttgtgggaaaggcggcaacattaaaagaggtacaggtgctggttaccagccgtaagctgtcctctttttccgatttgcttcctctgctggagaagctgggaaactgtcctctttttctggtggcagatgagattgagggagaggtcctgaccctgttaagagccaatatggaaaaacgcagaattgctgtctgggccgtaaaagcgcccggcatcggaaaacggaaggcagatatgctggcagatttagcagtacttaccgggactaaggtatatggagaatacgacttcttatcatgggaagaactttccccagacatgttgggaagagcagatgccatagaggtgacggaagcatattccgtggtagaaggcagaaccggtgaagcagcagcccggcggatcactgagatacgaaagatgattgatgacccgaagacaaatttttatgaccagcaggttctaagggagcggattgcctggctgtccggccgtgttccggtgatttatgcaggcggtgagacgaccatggaagtcaaagaagtaaagctgcggctggaatatgcagctgcctatgctcagtcagtgaagaaatatgggatgcttcctgaaagctttgcaaacggaatttctgctgaaacggaggcggaaaaaatcgttcttgcaggaatcagaaaaagtctggatgacaaagaaatcagcgccgggctttttattcttcttttactgaaaatcaccagtctgacagccatgtggctgacggcgggagctgttatggtgagcaccggctatgacagggaagacttagagctgatgaggagcggagtggatgtagaaaggcttaagggaagcgatggatattaaaaacgtaaaattaaagcctggctatatattaaaagagctggggggagaattctgtatttttgatgaaagggacagtcagagcggttctcttgatggtctgccctcggtcaatgagacctgcatctttctctggaataatttagagcggggagcagccctttctgatttggttaagcttctggaagaaaaagatgggatagacgaggatgaggcctggctggagctggaggaatttcttgcaaagctgataaatggaaatgtagtggaagtagagaggtgattctatggcgaaagttgcagtatttttaaaaaacggaagtctggctccgtttatggagtgtaacatggtgtgcatctatgaaaaggtgcagagtggctggaaccttttggataccgcatcatttcctcctgtaccggggggaaccatcagggaaacacggatgggaatgaaagaaattcttcctcttgcagagggatcagatgcgatttgcagcagggaaatcaccgggataccctttgctgaattcgaccgggccggttactgcatcttttcggttgatgcggtaaatgaccagacgctggacggaattctggaggatattgaagcaagtgatgaaaagaaacggctccgggatgaaatcataaagaatgccagaccggcagagacggaagaaccaggagtatacgttctggatttaatcatgcttcagaaggaatgccctgagatatcctcgaaaaaagccctgcgggaattcttagatacggtgccttttctggaacttcgtatagactgtgcccatatcccaccgtggctggaacgggaagaccggtttgaactgaaatcccagtccggggatggagccgtgcgtgtggtcctgacgaaaaaacaatgctgatacggaggtggaagtatgcaaaattatatgtggcttgagcatggatatctgcagacatcctatggcatttttgccggtgtggatggaatcagtacatacacaggcggagaagtggaaagtctgcgcttatcggaacgcaatgtaatcatgacggaaatcggggaactgattcctgcttatacggaaaataaccgccggaaaaataaggcatcggtagaatttgaccgccagggccttgtaaccggagtgctgttggaggaaatgcaggaggtgcagacacctatcggagagctgcctgcagagcgggttaagttttattccacgggagagctttaccgtctgtttatcctggacggccagatcagcggattctggtcagagactgacgaaagggaaatgaatattcccttgagctttcatttaggctttacttctttccaagccatgttaaatggcatctgcttttaccgggagggaggaatccgcagcatcaccctgtttccgggcgaacgcatcacggttatgacgcctcttggggaggtggagaccggtgtgggcctgtcgttatatgaatcaggagcactctgctcggtggagcctgcagaggccgtggcggttgagacgcccatcgggcagctgaccgcttatgatcctgagcagaacggactgaatgcggacagcaattccctggtatttacagaagacggaaagataggcggtctcattacctgtgaaaatctgatctatgtacagacggaggaaggggggttggagacgtttacgccaaaggtgaaagttcatccattatatgacgataccattactgtgtcagggatgcatgtggagtttgattataagaacgatgaggtaaccattgacggccatgtattcagcctgtcagaatgcggcttcacagcggcaccctttgccagaccaggcatgcactgcacgccggcggactgcgcaagctgttctgtttgcaataaaggttaggatgtgccggtaaaacggccgctggaaaaatgatcacaggaggagtaagttatgacagagagagaaaaactggaaggcttaatcggagatgtgtacgtggatacacatgaattggagaaagaattaaagaaaaagctggaggcctatgaggtttactgcgaggggaaaagagtgtttgtcctgtttgaacggaggggagaagagtatgaactggaactggacgtaaaggataagtattatcatgttgttgcggtgaaaaaataaagaaacagcagctgccaggatgaaatttatttagatttcatcctggcaggctttgtcaggttcttctttgcagattcatgctgtattcatatttgccggctttgggtccgattatgacatattcaaatgggctttgctcaatataggtgtttctgtttcctggtaaattgtttaaactcctgcaagagtattaagaacatgtgggagatatgagaattggtaaataaaaaattacaagatagtctgtttaatagtcatataatcctcacatctctgtgataaattataatggaaatgtaataaaccaatactttctaatagacgtttcctatcatataatttaaaggcaggaccgggaatgataaaatcacagatgaaggggaaaatatatgaaaaaaaacagaactattctcattgtggatgacgaggaaaaaataatagatgtattgcgggcatatttagaaaaagaaggctatcaggtattaagcgcttatgatggaactaccgcaatggaattatttaaatccaatgatcttgctctggttttacttgatttaatgctgccggatattatgggagagcaggtttgtcaaatgatacgcatgaattcaagggttccgattgttatgctgacagcgaaaacagaagagacagatttgataaaagggcttcaaatgggtgcagatgattatatttttaaaccgttcagccccagaactatcgttgcaaaagtagaggctattttaaggcggatggaaagtgatgagcttaccagcattccggtctcatataatcaaggatatcttctcattgattttcaaaacggagaagtcagggttcacggtaaggatgcaggcctgacgccgacagaatataaaatactggcaaccatggccaaggctccgaaccggatatttaccagagagcagctgataatctacgctctgggtgatgattttgacggatatgacagaagcattgatacttatatcaagagcatacgaacaaaaatagaaaaagaccgtaaaaaaccgaactttattcttactgttcatggaaccgggtataaatttgcaggagcagagtcatgaaaaaaactttgaaaggcactcttatcatttcatattccgccatagcagtattaattgtcctgtgcctgagtcttttctttcatgtgacagctgacagtatttttgaacattatgcaaaaacacagcagaagaatcagattgatcaaatcatttcccaaatcaatcagctgtataattccaaaaccggttcatacgatttgaaagggattgaaattattggatatgcagccttgcagaatggtatcattacacatgtgcaatcagtcaacaaagaaattgactgggatatccaaaaccacagggcagaagaatgcgagatggtattacagcatgctgaaaacaatatgaataaaaaatatcctaattttagagggagctatacggaggaagtctatcaattagagaacggcgggaatattaccggaacactgaaaataggctattacggtccatactccttgaatgacgaggaactggagcttttaaaggagttgaataagtcgcttttgctgattggaagcttttctctttttgtagtcattattctgggtgtactcattgctcgggcagtttcaaagcctattaccggcgtcattcaagtagcccagaggatagcaggcggtgagtatggggtacaggcggaaaagaaaactgctatggtggaaacaacgaatctggtgaaatccattaatgagatgtctttagcgcttcgggaggacgaaaagcagaaacggcagataaccgtagatgtagcgcacgagctccgcacgccccttacaaatcttcagtcacatctggaagccatgctggatggtgtctgggctgcagacgccgagcatctggagagctgccatgctgagatactccgcctggttgagattgtgggacagctgcaggagctatatactctggagagccggaagcagacactggacaaggcagatctggaatttcatgatttatgtggggctgtattccgggattttgaaataaagaggcaggataaaaatatcagcctttgtatggaaatgccggaaaaaacgccggtgtacgccgactattacagattgaaacagtgtatggtaaaccttctttccaatgccctgacttatactccgccaggaggaacgattacggtggagtacaaaaaatcagacagtaagatcataatcaaggtaaaagacagcggctccggaattccagagtcagatctgccatatttatttgaccggttttaccgtgtagacaagtccagaagtaaaaaaaccggaggcatgggaatcggactttctattacgaaagcaattgtagaaaagcatgggggagagatttacgcagaaagtgaaaacggacaaggggctatgtttaccatggtatttcccggctaacggtgtaatagaaaaagtccagtaaaaacatttcaataaacaaaacagcactgccagttatggcagtgctgttttgctggaactcataaaatccacacattctttttgtatgattaatatatgacttggaataaaggcggtaataggaaggagagcatgaaacatgagggaatacaggaatgggggaagaagaagccgaaaaaaaaagagggttcatccctataaagaaaaatggtttaacatcagtatgattatacagggtgcggttattttgtgtttcttaactgctgcatttttttatataccgtcatccctccgaaaaggaagaggagccggcaatgtggaagtacagtcttctgttaaagagatgattgaggagacaactcccccggaaacagaaacgaaagctcctgaaagagtggtaagagacattaaaattgatgatatatctattatgggattaacaaaagaagaaacaagagaaaagcttttaaatacttatacgtggaatattcagctgaaatacggcgaaaaagttgaacccatagaaaatccgctgccgcagagggtggaggaattagtggaaaaaatatattctgaaaatgagaataaagggaatggagtataccgtttggatttgtcagatatcgaaggtgttataagagctcagatagaaaaggcagctgccaaatgggacaaagcgccattaaatggacaattaacaggctgggataaggaaaataaaagatggatttactcggaaggagagaatggtgcagaaatcaatcaggaaaaagcagttcaggacattatgaatgctgtgaagaataaaaaatttgaagaaatcattcttgtggaccatagtaaaaaggctcctgagctttcggcagccggggcaaaaaaagaatataaagtaatcggaacattttccacggtggctaccagtaaccagaatcgaaacaataatatcctattagcaataaatgctttaaatggattggtgattttccctggagaggagttttcatttaataagacgacaggtaaccgtaccattgaacgtgggtataaaccggccggtgcttatcgaaacggagaatttgttgaagagcctggcggaggtgtctgccaggtttcctctacgttatataacgcaattatcttttcaggtatcaaaacaacagagcgtaatcctcatagctttgaaccttcctatgtaactccaggcgaagattccatggtcagctacgatggttacagcgggccggacttgcggtttgtaaacaaacaaaacacatctgttgcaatccgcgctgtttttgaagataaaaaactgacggtttcaattattggcatgccgattctggaggatggagttaaggtgtccatgcggtccgagaagacgaaagattatgacccgcctgctccaaagtatgaggaagaccagactctgcagcctgggcaggaggtagaaacaacagaaggagtgaagggcagcacctggaagacctatctggttacatcaaaggatggaaaggtaatcaaagaagactatttccataccagtacctatcgaggaaaggctggtgttgtaaagaggaatacttccggaattgtgattcctgctgaaacagaagcacctcatacaacagaaccgccagtggagtctgctggcgccgctgagacggtttcacccgatgagagtgctgcagagacaatacaggaaagccaggctcctgaacatagtgacagcaatggaacgcaaaatccactcccaacaccaacagagacggaaaaaaagccggtagggcccggaatcgcagcaaatgaaacagagtaaggaatctgaaaggaactgaaatttcaaagaaacctgagaacactgtaacgaagcgcgtgcagtacgaaggcctgattattggtgaagaaggtgaaagtgttgaaagagtgcagagcctgctgagcgagtttgggtatctgccttctgggaaatggcaaggtgattgatgcctcatcaggtaatggaaaggtcgtctatcgccaaagaacgaagtggtggagagataattttatagtggtatggaggatttttttgttatgcgtggtgtttcctattatggctcatgcaatgaaccggaactggcggaggctatggatggattatgcaaaaagtatggaagtttagacaaaaaagctttaaaagacctttatcctgtgggggcgcatgttgcctattataagaaattcggcagcagctatcatctgttaccacaattggaatccgtactaaaagggagaaaagacctgcatttcaaatccgggttgctaccgaatctacaaaggaagttctttttctagtttatgcaccgcccggcatcaaaacggattacattgaaaaaagtcttatgaagctggagaaacgcattagaaatttttcatcttctgcagcaacagaattgctgcgggtttatagttaaacagcttaaacgttgtttggaggaaagcaattaaaattgctgatgccggctggtttagtccgttcccttaccctgtaattaagccttattatgaaatgatgaggaccggttactcaatttaatactccaaaagtcttttttagaacataatgattatattatgtaagcggatatattattattttaaaataactagagtaagatcattcggtatgagattcatcgaatgtggagtctcaaattttaagaagagggattgtgaatggttataactacgatggcaataaatgaatatttagataacatgggagtcaaacatacctacgctggctacaaatatttggttgaagcaatcatgttaggagctgagcgcactcatgcaattgggatcatgaaaatatatgatcagattgcacaaattcataatacaaaaagcagcttgattgaaagagcgataaggtcggctatcacttcattcggattgagcaacaaagaatttatttcaaaagcaatagatgacataatttatagtcctgaatttattggagattatgaagaatatgaacaaaaacaagaagcaggtaaaagcagaagccctgctgcaatggaatgcagtggtttggatgaggttagaaaaaacgttgatagaattgataatgagatagtcaggcttatatatgagaggcaaacatacgttattcaggcttctgcctttaagaaaagtgaagatgaggtaaacgctcctgaccgtgttgaagcagttatctctaaggttcgtacaaaagcgtcagagcttggaacaaatccagatatgatagaagctttgtatcgtaaaatgataagttggtttattgatgcagaaaagaaggtattttataatgactgatataaatggttaaaattgatttaatcaggcgttattattgatcccttataatgtgcgaaattctacataatgatataattgcatgcaatttaaggacagggactgggttcaatatacggtatccctgataaagtttttatttggcatcagagttccgaaagataaaggcagacgtgtaggctcagcctccgttatattgaaccctccgtatgaaatataaaatttacttttgcattgaatttaagaactctttcattgcccttgtaatatatttgctggttttatgataaaagtaaatgtttctcaccgtatgtacgctgtcgattttataatatatgacacggggatctggtaaggtttcttttaccagtgtatcactgatcaatgttattcccataccgttgcaggcagtgtggtatgcggtcgccaattgatccaattccagtacgatattgggtttgatcccgtgttcttcaaatattctgtccgctctggtacgtgtatcatttccgaatcgcagcagtataaacggggcgtcttcaaatttatccaaagggactgcaggaatagatgaatgtaaatgcctgttatttacaatatcttctgtagtcaggcagtatttttttgcattcttgttgtaatggaatttcactggaaccgccagtatcatttgttcctgataaaaaaagtgcttttggtagatagcttcattaaacggataattatctataatcagatctaattcaccggcatgaagatatttttccagatgtacggtattagcttcgatcaaattaacagctacccgcggatattttgacttgaattttgtaatgatcggaggaagaatataagaagcaaagaaattactggccccaattgccaaagtacctgatttcaagtcacttaaatcacttaaataagtttcaaagccattttctatatccattattttctcgacacatcgtatatattcctcaccacaatcagttaatcgtatgggcgtcgtactgcgatcaaataattgagagccaatttgtgtttcgactttttttattgtcaggcttaatgacggctgggtgataaataatttttcagctgccttggagaaacttttagctttataaacttcataaacatactctttattggaaaacatatctgcctcctatatcccataaataaaaatttatattgtcagtaaatatatttatatgtgtttaatatactgcgtgatttattaataagcaagtagtaacacgggttattaatttttatttatgattctcatattcatatttatatttgtttttggaaaacggcgactatataatgaggtctagagaaagccataagcttaaatagaatgaaagaggtaattgataatggataaggaaacggtagttgagacaaggcaggaatatgattccataggcaccaaggaggttcctcttaatgcatattacggaattcagacactccgggcagcagaaaacttttatattaccggtttaaatatgcatccagaaattattaacagtattgtgcagataaaaaaagctgccgcaatcacaaatttcgaggtggggcagctggataaaaaatgtgcagacgccattgtgcgtgcctgcgatgaaatcctgtcggggaaattttatgaccagtttattgtagatcctattcagggggtgcaggaacatcacttaacatgaatgccaacgaagtaatcgccaaccgtgcgattgaactgatgggcggtaataaaggcgattatactctggtgaatcccaatgaccacgtgaatcatgggcagtctacaaatgatgtattcccttcctgcggacgaatgacgactttaaagcttctgaataaagccactgtggagcttgaacggctctatcatgttttatcccaaaaagcggaggagtttgaccatgtcattaagatgggacggacacagctgcaggatgcggttccgattcgtttggggcaggagtttcgggcttacagtacggcaatcagaagggatattgcccgttttgaaaatgcgaaaaaggaaatgagcgccctcaatatgggcggtaccgcaattggtacgggcctcaatgctgatgtaaaatatatgcaaagggtcgtgaaaaacatggcattagtttccggcctggatcttatacaggcatttgatttaatcgatgctacacaaaacttagatggctacacatttgtgtcaggtacagtaagaacctgtgcggtaaatctttccaaaatggcaaatgatcttcggttgatgtcttccggcccaagaaccggattaggagagattaatcttccgccaaagcagcagggatcttcgattatgccgggaaaagtgaatcctgtaattcccgaggttgtcaaccaggtagcctttaatatcattggaaacgacacgaccatcaccatggcaacagaagccgggcaattagaattgaacgcttttgagccgattatattttataatctgttccagtcaatcgaaacgttgacttatgcagtacgtaccttgattgacaactgtattaccggaataacagccaacgaggaacattgccgaagcatggttgaaaatagtgtgggcatcattacagccatcagcccatatgtgggatacaataaggcgtctgcatatgcaaaagaagccatacatacaggggtatatgtcaaagatttaattttaaaagaaaagttgttttccaaagaggatctggaacagatattagatccttattccatgacggaaccgggaatttcaggcaaacttttgagtaaatctcaaaatgcggtggtctaggagtaggcaacataaaggatttatattaacttataaagttaacgcaactgctttgcagtgcgtaccagataagtgttatcagacttttaatggatttattctaaggttcgtttgccggaatagatgcattagaagtctttttgtttataatggaagggtatttttttgcaccgaaatgcggaaaatgcatatttgagatccattgaaaaagaatatatactgacataaaaagagagaaaggaggaaaaagggatgaggaatattctgcttgcgtgcggagtcggtgcttccagcggctttatagcacagaagatgagaaaggcggctgagaaaaaaggtctggaggtagaaatcagagccgtcagtgacacggagattcttgagaatattgaaggggtcggagttctgcttatcggcccgcatttgaaacacaaatttgaagagatccaggaagaagtgagcggttataaagtaaaggcggccattattgaccggaaatactatgccacactggatggagaagcagttttgaaaacagcactggatatgatgggggaataaacatatgatggaaaaattcatgaactggatgggggatgttgtggccccgaagatggaagaattaactggaaatgcatggctttccgcgctgcagaaggcaattatcaagaccctgccaatggttttggtgggttctctgatcaccatttacaacgttattaaaaattttatcccggcacttcctgtattgacggatttaagaaattacacctttggactgatttcgattttcatggtattcctgattccatattatgttctggaattaaagaaaaacaataagatgaagctgacggccggatttaccggcattgcgctgtttatgatcattgtaaatccgcaggtgacggacgcgggttacatatatcagtttacaagctttggggcgggcggcatgttcgtggcaattgtggcaggactgttcacggcggcggtgatgaatctgtttgcttcctttacctttttcaagaaaaattccgtggttccggattttgtgaaggaatggtttgattccatgatccccattgcgacagttgtactgatcggttggtttgtggtgcttcagtgccgttttgacatgtacagctttattgtcaacttattctcaccgttaaacagcattgcccaatccctgccgggaatgatcctgctttatctgattcccaccatattgtactccatgggaatcagcggctgggtattccagccaatcttaaatcccatctgccttgtggcgatcacagctaacgcggatgcggtggcttcgggaatggcagccacacagccctttaccaatgaggcgacgtatgcgtggctgagccttggaggaagaggagctaccctgccattgtccattatgctgttttttgcggcgtcaaagcagcttaaggccctgggcaaggcttccattgtaccaagcctgttgaatatcaatgaacccgttgtgtttggctgtgtagcatggaatccgcttctgatgatacccatgtggatcaccgcgatcgtccttccggtcatcacctacctggctcaggtctcaggactggtggcaattccggcagaagttttcaatctgtggtattgtccggtattcatcagttcctggctggttaaccacagtttatctggcctggtgctgacagcagtcaatctattggcggcaactattatatttttcccgtttttcaaactttacgacaagagacagtctgaactggaaaaacaggaggaagcaaaaggttaaaaggagaaatcgctatgacagcagaagacagacatgaaatattaaacgagacggataatgaccaaagagaacagactgcagcggttgccatgcagatcgttattcgcgcaggagatgcaaggaacctgatcatggaggcgcttgactgtataggggagagtcagttcagtgctgctcaggaacggttaaaagaagcccaggctgagatccgccaggcgcacattgcccagactgaagtgatccaggcggaggcaggaggaaaagaatttgcctattccatgctttttacccatgctcaggatacggtaatgaccatcaatacggaattgaatctggcaaagaaactgtgcagtatgtttgaaaagatggatatgcgtatctcgaagctggaacatggcggagggctggcagtatgaaaactgtaaaccgggaatttcccgacagcttcctctggggaggggcaattgccgccaatcaggcggacggtgcctcccttctgggaggaaaaggtttttccattgcggactatcatccatatataaaaaaagaaatgagagacgacagaagagaggatgcggcaatcagaaatgatgagaactgcctgaaaatagattccggtctgtattacccgaagcagtatggcattgatttctatcaccggttccgggaggatttaaggctgatgaaggaaatgggaatgaaatgctttcggacttcctttgactggagcagaatatatcccagaggcgatgagaattaccccaatcaggaggggcttgactattatgatgagctgatcgataccatccgggagtgcgggatggagccggttatgacgatttcccactatgagatgcccattcacctggtaaaggcgtacggcggctggcttggcagaaagaccgtggaatgctttgagcggtactgtgatacgctgtttaagcggtatcacggaaaggtcagatactggatcaccttcaaccagatcaatcttctgacctttaattccctggggatcctgggggaccgggcggataacttcaaggaggctgtttatcagggcgttcaccaccagtttgtggcatccgctatagcaaagaagacggcattgtcctattccggtgatcttctggtggggaccatggtcagtgacaagatcgcccatccggccacctgcaggccggaggatgttttattcaatttaagaaagaaccaaatgcagtttttattttccgacgtacagataagaggagaatatccaggctatgcggcgagatattttgaggatgagaatataaagctccggatggaacccggggatgaggaattgctgaaacaatatcccatggattttctgtcgtttagttattattatacgaaaatcaatgattccaggaaaaattcatttgaagccatggataaaagcagcaatccttatctggaaaaatcggaatggggctgggagattgatcccctgggtctgaggaccgctttaaatacctatagcgaccggtatcctggaatccctctttttattacggaaaacggtcttggggccagggacaggctggatccggacggaagcgttcacgattcctaccggatctcctacctaaaagctcacgtggagcagatgaaggaggcgatcgcggatggggtaaacctgatcggatattgcttatggtccccatagacattgtcagctgctcatccgccgagatgtcaaagaggtacggctgcatttatgtggatcaggatgatgagggaaaagggagcaaaaacaggtaccgcaaggacagtttctattggtataaacaagtcatccacagcaacggcagatcgctggaatgggaggcatgatgggaggcagaaagaaagcggcgctctgggcgctggcggcaggaagcctgtggggaacaataggcctttttgttaagctgttgtccggttatggattttcttccatccagctgacggtgatccgttttgttgtttctgtcctgcttgttaccctgtttttctgttggaagaaccctggagcatttctcattgccccaaggatgtggtctggtttctggtgacaggagtgtgctgcatgctgttttttaacatctgctacgccgtgaccatttccaagtcctccatggcaacggcggcggtacttttgtatacgtcgcctgctctggtttcagtgatatccgtccccttatttaaggaaaaaccgtgcaaaagaagatttctgtccgtcctgctggctatcacaggctgtgcctttgtgtccgggattttttcgagccagatgcggatatctacggaaacggttctttgggggcttggcgcggcttttggttatgctatgtacagcataaccgcaggaatacttctgaaacgatattcttccatgaccgtgctttattatacttttgtggccgcagccctggcgggaatcttcattggacagccccaaaatgcggcggcggtcatcagggctaaccctgagaccctgatcatatttgtactgttttcgcttctttgcaacattttctcttatttctgctataaccgggcactggagaaaatagaagcgagcagcgtttccatactggcctccgtggaaccggtggtggcggctttactgggctttttgattctaaaagagccaatcactttggcaggagtggtcggaatctgctgtgtcctggcggctgtgctgattctgaatggacctgaaaagggaaaggcggaggaatgatgaaagggaagttacttgacgtaatcaggaatttattaaaggaagatgagccggttacggcaaaacagctttcagccgtcttaaagatgtctgaaagaagcatcaaaaactatataagtgagatcaattattttgaacccggcctgattgacggaagcagaaagggatatcggattaataaggagaggggaaaagccgccttgcttgggcagaatatccgcattccggaaacacctggagagagaatcggctttattatccttaagcttcttgcaaaggatggggaagaggtccgggaaatggacctatatgatattggtgaaaagctgtttgtaagctatgaaaccgtgaaaaaggatatgagcagggtccggaaaaagctgaaggaatttgagctgtatattaatactgatggaagcaggatcacagtggagggaaaggagcggaacaaaaggcgtctgttaagctccgtgctgtatgaggaattcagccggaatgtgctgagccttaatgtggtccagaaggcatttcccgattatgatctggaagtgctgagagaaatcattttaaagcagtgtaagaagttccgctattttgtcaatgattatgccatgctcaatctgatcatggatgtagtcataagcatggaccggatcagaaaaaagcgcacgttcatcacacatattcctgaaaagaggatattcggaacaagggaaaaagaattgtcagaaagcatcatccggcagatcgaagaaatttacgatattgtttataataagctggaaagagaggagctgacaggtattctggtcagccatttcatgaaggtggatttcggaagcttaaatcagggcgggctcatagaaactgtgggagccgagtgctatgaggtggtgtgccgtcttctggactatctcaaggagaattatctcattgacgtggagaatgaggattttaccattaagtttacgcttcatatcagcaatttgctgtccaggctgaaaaatcactattcagccaggaatccgctggcggagcacatcaagaatacctgccccctgatttttgactgcgcggtcagtttggcagacaagctccatgaattgaccggataccgggtaggggaagatgagatcgcctatattgcccttcatatcggaggaaatttaacgacaggaggcaaagggcgggatcagctgaagtgtattttgctgtttccccagtattatgatttttcggaacgcatcatggaacgcattaaagaggaatttggggaaagactggccataatggctgtagtcactgacctttgggaaatagaaggtctggaaataccggatctggtcatttccacccttcctgcagaggaagccggtactcaggagtgggtgctggtctcgccctttttaaatgacagggatattgcggggattaaggagaagatcgaaaaggtgaagatgacaaaaagaaagcagcatttaaagaagcttttgatacagatcgcctccgaagagctcttttgtaagaatccggaagtgaaggatcaaaaggaggccctgagttttatggtgaattgcatggagcaggcagaatatgtggagccggggtttattgatcaggtgctggagcgggaagagcactcatcaacatctttcggacatattgccgttccccattctctgaaaatggatgcccataagacgggaatgtttgtcatgctgtcaaacaggcccataccatggggggagcacatggtacggatcatcctgctgttttccgtgaaccgggaagacagggctgtttttcatgaagtttttgataatctggttgtcctgcttctggaaaccattcatgcggaccggatactgaagtgtgattcctatgaggagtttattgatacaatcgttgaatgctttcaataggagggcgtatgagacaatttcagcataaaattctccatgaaggagggctgcatgccagggtggccgtcagcctggccggaatatgcagggactatgaaagcagagtattcattcagaaaggtcgcttggccggagactgcaaagacgtattttccatgatgaatttaaaggcgggtcaaggggaagtgctgacctttgtgatcgaaggaaccgacgaggcagaggtggaggagcagatcagtcagtggattctaattttttctttttaacagttccgcatacatccaaccattatattttaagattgactggtcttttaaaatagacatttgatgccgccattcccttggggttgtattcattatttctgagaagtggcggttaaaactggagacagaatggaagcctacccgttcagagatattgaccacagagtcttctgtcatgcgcagcaaatccgctgcttttcggatgcgtatgctgtttaaatgttccagagggctggtgtgcatcacagaggaaaagagtcttcgaaaatgtgtgggactgagtccgcataaagctgcaagatattccatttgaaagtcatccatatagtggtaacggacataattcagagcaggagcaatgaccagggcgtttttgggctggtcattgcccctgttttttatggcggatgtaattctcatcaagttagtagccagcgccaggaagaggccgcggacactaagctcgtacccatcctctttttgcttcatctcgtcaataattctgatgattagggagtagatgataggatattcctcccggctcatgatcagactaaggtgatgctcagaaaaagacaggagatctatgttctggatatcagttcctaagaagagtggatataataaatcggctaagttcacaaaaaggtaggaccatttactggtgaagcctgtggtgctgtatgtggtatgggggatgtcgcaggaaacaactgtaacatcacctgcgtgaaaaggataagcggtgtcctcgaattccattgtaccgctgtctgattcacagaaaccgatctccaggcagttatgaatgtggaggcgcccggaaggaatatcagaaatccgccaatgctccccagtaagcaaaaggactggaaaatgcgacggtaaatgataatctctgtattcaatgatagatttcttaggtctggccatgttactcctccgtcttttcctagtgataccttgattatataatataaccaattgaattttcaaccatttatatctttgataataaaaagaaagtttgacaaaatgttcaaaaaaaagtgggaaagtaacagatagttaacgaaaaagataaaatagtacggaatatccagcgataaatggttgaaaatgagcagttttcgcaggggatcgctttgaaatgggattgtgattttcatataatgaatccataagtaaaacattcaggaagtaaaaagtaataaagggggatggagacagactatgaaaagatcaaagacgcctgctgccgcagtactttatactcagaacaaacagcatagtatcggttggtacttgagacgggactggcagttgtatgctttgctggtacttcccatgctgtttatattggtatttaagtttttgccttatacgggactgtccatcgcgtttaaagactacaaggtggcaaaaggatatgcaggaagtaaatgggtaggactggatatcttcgggaaagtttttaaaaagagggattttggacagtcggtttataataccctgcttttaaatgttctggatctgttattcggatttccgatgccgattatcctggcgttgatcctaaatgaagtcaaaagtaaatattttaaaaagataactcagactctattataccttcctcacttcttgtcctggattattatcggaggtatcgcatattccatgttttccttaagcaatggtgtggtaaatgctcttatacagaatataggacacagtccggttccgtttttacagggaaatggctggtggctgttcagctatgtgctgattggcgtatggcagtccatgggctggggaacgatcatttatctggcggcaatcactggtgtaaattcagaactttatgaagctgccagggtagatggggccggaagatggaagcaatgtgtacatgtgacgattccatgtatccggagtaccatcgtaaccttgcttattatgaacatgggtaagctgatgggaggctcctttgagcgcatctttgctctctgtaatgctaaggcgacacagtacacgactaccattccggttctggtctatcgttggggaattggagacggaaagttcagtgaagcgacggcacttgggctgttccagtcggtgatcggtttgattctggtgctggcggcagactgggttgcaaagaagctgggtgaagatggactgatctaaaggaggatcaagtatgagtctgaataaaaagaatcatgaccgcagatggatcaatacaaagacgaagaatatggcgatagacattatgttttatatggttctgaccctggtgagtcttacttgtgtgcttccatttatacatatttttgcgaaatcggtcagtaatgaagcattcgtcgtagccaataaggtatttctgattcccaaagggattaactttacggcttataaaaagatatttcaggatgtgtccattgtacgttccttgtatgtatcggtcatagtgactctttcttttacggtcattggcatggtgctgaccatcagttccgcctatgcactgaccagaaaggaattaaagggccgtaaggtgatgagctttctgattatgtttacgatgtattttacagcaggcaccattcccgattatttgctgatgaatgatcttaaaatgctggatacctggtggtgtatgattttaccgttgtcattttcggcgtataactttttaattatgatgaataattttcagtcatccattcccgaaagcttgatagaatcagcggttattgatggagccgggcattttaagattctgacaaaaatcgtgattccgctttccaagcccatcatcgccaccattgcacttttttatgcagtaggacgctggaatgcctattccgatgcattgttctatatcaagcagagggtgaatttaagacctttacaattgaaactatactatctggttgtggcagccacggaatcctttaaggcggaaggagttgtagctacaggacagatcacgaacccggaggtgcttaaggcatcctgcattatatttgcaacattgccgattgtctgcatctatccttttgtacagaagtactttgtgcgcgggactatgattggtgcagtcaaaggctgatgataaagcaagaatatgaaaaggaggaagtattatgaggagggcaatgacatgtaaaaggctggcagcttttggtgcggctgtcatcatggcagcaggcgcggtaactggctgcggaggcaaaaaagaggagacgacggcaacgacggcagggggcggtgccgccactgcgtccacggaagcgggaggtgtttctgaggctggaagcttcacggactattctgctggtttcccggagaatgtgacaatcaaaattccggtttatgaccgtggatttgagggctgggatccggcaaataattattatacgaaatggatccaaaaggaatttggggataagtacaatgtcactttgaattatgtaggtatcaatcgtcagaatgaagtgacagattatatgcagatgatcgctgcgggcaatgcgccggatatcatctttcattatgatatgccgcaagcagtaaactacaatggggaaggtgccatgcaggagttgaatctggatgagattcagtactatgcaccggcctattatgataaattaggtgataccatcaaaaaatacggacagttggatgggaaaaacacgttctttttcgcaggaagaaatgctatttattacaactatgtgcacctgatccgtcaggattggttaaataaggtgggtatggaaaagccaacgacaagagaggaactggatgcagttatggctgcctggaaggaagccggtcttgggacacgcggagattatctgatcaacaagagctatacctatgaatatccatttatcgggtctgatccagataagaatgaactggcgttatatctggatctgaatgtagcgcctcttacctggcaggcgaccaaagattatctggtaacaatgaataaagaatttaatgaggggattttagatcctgaattctacttaaatacggatgacgctgcgtggaaagcagattttgtagctggtaatgtggggacttacagcttttatattgcagccaatacggatgtgatcagcagcttgaaagccaacgatcccaatgcggaggtttctgttatgtctccaaaggctttagcccctgcgggtagtcagccatattattatgaatatccgccttacggtatggtcatgggaattaactccactgccagtgatatgcagcgggcggcaatctggatgttcctggactggatgattcagccggagaatttattcttcctgcaaaatggcatggaaggggtaaattatacgctgaatgaagaaggcattgcagttccggtaccagattttgcaggggagtctaagctttccaacaataacaataaagattactggtgcctggtagccgaggtggctgattatggtgacgaaaccaagaattttaaggcaaacttaaagacattggctccggcaggctatgagcagctggttcagaatgcttatgattacgacaaggaaattaaagaatatgggatcatcagtccgatctttacaaaaagtattgaagctacgaatgaatacaaagccgatttaacagcaatgtggcaggaattctacgttgatatggttacctgcaagccggaagaacttgaggccaagtatgatgcatactgcaaggaatatttggataacggatatcaggaaattcttgatgagaaacaggcattgattgatgccggggattatatcaaatagtttggcaaggaataaatgagacgaagaatggaaaaaggctgctgcaaatttgcggcagctttttaaccccatcaaacaggttcgcggatcgcgatgatccgattgacccaaaagaaaggatgaaactatggctggactggtgtatgagaaagataagatagaagtacttgtagatcgcatggtaaagcgcaccatgcgtatggatatgacatgggattggccgtgcggagttgcttattatggtatttgcaaggcatatgaagtgacaggaaatgaagaatatatcaatctgttgaaagatagaattgatgagttcatagaattgggagtgcccaaggtttggacagtcaatacatgtgccatggggcattgtttattaactttgtatgaagtgaccaatgatgaacggtattggagtctggtaatgagtaaagcagagtatttacgaaaggaagctctgcgctttggtgagaatgtgcttcagcatacggtctcagcggggaatgattttccggagcagtgctgggcggataccctttttatggcggcatactttttattgcgggtaggggtgaagcttaaagaggatgcactgatcgacgacgcactgaaccaatattactggcacatccgttatctacaaaatccggatgccggactgtggtatcatggatataacaatatcaaaaaagaccatatgtccggattttactggggaagagccaatgcatgggcttcctacaccatgtcccaggtgggcatttgtctgcctgagtgctacttatatccccgctttatggatgtggcaggttctttgaatgaacagttggcagcattgaagcttcttcagactgacaggggactctggcgaaccatactggatgatgaagaatcttatgaggaggtatcggcatcttgcggaattgcggctgccatgattgcgaaagggaatccccttcatatcaaatacataaataaagccattgccggaattgtgaatgagatcagcgaagatggaagagttcttcatgtgtccggcggaactgcggtaatgagagaccgtgacgggtaccggaatatatcaagagactggatccaaggctggggacaaggattggcacttgcttttttcgcaggcatactggattatgacaacagcagaaatgatggggcattatgagacagtgcctgatgggaccggcagaataataaagaggtaaaaggagacagatatgacggaaaaacgaaccgggagttttacgctgccaggggaatccggatatgaaaaattgacactggagttagcacagcgttggggcgcagatgtgatccgggatagtgatggtactgtgctttcagaagaaataacagatgccggttatggcatttattccacgatctgtatcatcagggatcataatgaatgggcaaagcagcatccggaacagctgcagcagacctttctgatgacagaagggaagatggcggccggagaatctctggtatttcacctgatggaagatttctatgaggatcagtttgcagttaatgacagcatggaaggcatgaaatactggcaggtttttgaccggacggataatcaggcggtgccccgggggttatggaaatatgcccgggaatccggtaatgtgatcctgaggaatgcgattccatggcataagtatacggttagttttctggcctaccggatctgggaagagatatctatgtataaccatgtgaccaatcactgggagaaagagcatttaatgccagtagatccaagacatccggagaccagggaatatctttacggttggctgaagaactggtgtgaaactcatccgtccacaacggtggtgcgctttacttccctcttttataacttcgtttggatatggggccgggatgagcggaaacgcagccttttcagtgattggggttcctatgattttacggtcagtccgaaagcgcttgaagaatttgaacaggaatacggctatgcattgacggcagaagattttgtcaatcagggaaaattccatgtaacgcatatgcctccgggagaaaagcagcgggattacatggcatttatcaatcgctttgttgttgctttcggcaaagagctggtggaattggtgcatagctatgggaaaaaagcctatgtgttttacgatgacagctgggtgggcgcagaaccttacggtgatgagtttcagaaatttggatttgatggtttgattaaatgtgtattttccggttatgaagccagactgtgtgcaggtgttgaagtggagacccacgaactgcgcctgcatccctatttgttcccggttgggcttggcggggcgccgacgttttgtgaaggcggagatccagccggggaggctaaaaaatactgggtgcaggtgagacgggctctgctgcgggaaaagatcgaccggatcggattgggaggataccttcatctggtggaaggatatccggatttctgccgatatattgaaagcgcagcaaatgaattccgcctcattaaggaattccatcaggcaggagaggtgtatacgctggggattaatatcgctgtgctccattcctgggggcggctccgttcctggacgttgtcagggcattttcatgaaacgcatatgcatgatctgatacatatcaatgaggccctgtccggacttccggtacatgtgaaattcattcgttttgaagatgtaagaaataatggattaaaaggagtggatgtattaattaatgcaggtgcggcaggaactgcatggagcggcggggcagcatgggatgacagccgggtggtagaagccatttctcattttgtatttgagggaggagtgctggttggcgtcaacgagccatcggcagtggaaggatacgatacatatttccgtctcgcccacattctgggtgttgatgaggacacaggtgcaagagtgtgccatggccgttgggactatgaggtgaaacctgtggcagggctgattccggaaaaagcgggagtgaagggacgccaggggctttacttaaccgatggtaatacccgtgtactggcggaaacggatgggatgccaaccattgcaatgcacaagacaggaaacggttggggaatctatctcagcagtttccaggtgaatccccggaataccagaatgcttttaaatctgatgctttttggaaaaaacatgcctttgaagcagaactacctgacggataatccggaaacagaatgtgcatggtacccggcagacaaaaagttggtgctcatcaataatagtacatgtccgcagaaaactgtggttgaaacggaatatggcagatgtgaagagatgcttgagtcttatgagaccaggattattacactgggataaaggaaagccgtgtacaaagacaggggcggaaagggagcggactgcttaagtcttacaaggtaaaaatagagaatggcgtggtgaccgttctctatttttgtgcggaaaaagagagaatctctcctaagttattttataggatgccggccacatgccaaaaggtgctgtgccgaataatgccgtgatagacggatagaggagctatcagtttatccggaacgaacagcagatccttttctgcctgtttcatcagatcgcaggaataatcgttgatacaccagtcaataatcacgcccgtgccggctgaaaggggacaccgtaagcagctgcattcgttacggttgccagccatttgatatttgaaaaacatgcattactttcaccgctgccagatattgctgtgaatcgtaaagaactaatatgattcaatataaatcaaaatgattgacattgaatcaaaatagtgctatagttaattcattgaatacggcggggaagtggcacctgaaattgggcaaaggaggtacggacagcagtattgaatgggtggagccggaacatgatacatagaaagatacgaaaccgcagaaaattattataatcaggaggattcaaaatgggggatataacaaagtttctctcgcctaagctgatcaaagttaacatgcaggcagaggataaaaatgcggcgatagaggagttggcggaacttctctataaggaacatgtactgaagaataaagccaactatattcaaaatgtattggaacgagaggcacaggtgcccactaatctggagaacggagtggctttgcctcacggaaaatccgatgcagtactgaggccggcggtggcaatcggaatatccaaacggggcatccggtttgaagaggggagccagcccagccatatcatctttctcatcgcaatgccaaacaatgcggacgacacgcatatcacactgttaagcggtattacttcccgcttgctggattgcgattgcctggaatatctaaaggaggcaaaacggccggaagatattcttgcggcactaagtacagaagaggtacggacagagaacaaagggtcagaacggtttttaatcggggtgaccggctgtacggtaggtgtagcacatacgtatctggcggcgaaagcattggcaaaagctgctgaagagatgggcgtatccataaaggtggaaacaaacggttccattggcacagaaaatgttcccaccagggaagagattgaaagagctgaaggaattatcattgccagcgacaaggagacggacatggaacgtttccgtggaaaacaggtaattaccaccactgtgaaggaaggaatcgaccatccgaaagagctgatccgaaaggttctggatggaaaggccccgatttttggcgggagatccacagagcgtgttctgcaggcggccagcggaaaggcagaagagccagtcagtgcgcttggtggaaagatgttatacaaggcgttgatgaacggtgtctcctttatgatcccgtttgtggtaatcggtggtctgctgattgcggtcgcgcttgcagtgggaggaaagccaacaccccaggggcttgtgatccctgaaggcagcttctggaatcagatttctgcagtgggaagcgccggatttacattgatgatcccgattctggccggctacatagcatttgctatcggtgacagggcggctttggctcctggcatgattggcggctggattgccaacaacggttctttttacggagcgtcagccggaactggctttattggagcaattgtggctggttttctgaccggatactttgtaagatggatgaagaagcttcgttggccggagatgatcaggccgttggttccgatcatgattattcctattattggatctttgtttatcgcatttgtatttatatttattatcggagcacccatttcatccctgatgacggctctttacgccatgctggaaagcatgtctgccggaagtatgattttacttggcattacaatcggtctgatgcagggctttgacatgggaggtccctttggcaaggtagcattcatgttctcggttggtttaattgccgaaggacagcctcagtttatgggagcacaggctatggcgattcctgttgcaccgttaggtatggcactggctacatttctagaccgtaagcaccagttgtttttgccggaggagactgccaacggcaaggcggctctggccatgggcttggtagggatctccgaaggagctattccgtttgcagcgggcgatccgctggccgtcattccggccaatatgattggatccgtggtggcctgtacgatgggatttttatttggcattacagattctgttgctcatggcggtcctattgtgctgatcctgggagcagtgaacaagccgtttatgggactgatctgtatggctgcaggcactgtggtaactgcaattatctgcatgactttaaagcgtcttagattaaaacaaagataagtacatcaactgtggcaaggataaccggaatggagccattacatcggttaagatcgatcgaaagaatgatagattgacatatgatttcctcctctgatatgataatggcgaaggaggtgacgttatgctatcacagcaaaggctttatcatatcatgagtatcgtaaaagaacagtcttttgtaaccataaaggaactgatggaacagttaaatgtgtcaaaatccacggtaacccgggatttaattgaactggaggaacaggggctggtcagcagggagcggggaggagctatgtgcagagaggtatcttctacactgacggtattcaacgaagttcctaccgtgaacaaggagagcctgtgtgcggaggcaaaggagcttgtctgccggcgggctgtcacaaatgtaaaggacggggactgcgtttatgtggactccggcactacccctgtatacttactgccgcagctgctggcgcaccatgtaaagattgtaacctcaagcatttacctgattaagaagattcccattacgtacaagggggatatctatctgctgggtggtcgtttttcaccggattatgatatgagttcaggatccatggctgtggatatgattcggaattttaattttgaccatgcttttttcagtaccaatggggttaatacggaaagcggcgaggtttacattttcgatatggagattgggacgatgaaaaaggagatcatgaagaagagccagaacaaccatcttctgatcgatgactccaagtatcatattaaggcaatgttctcatgggcaagtctggaagattttacaaacgtgtatgtcaatcgtctccctgacacaggtgagataccagataattttaccgtttgtctcagttaagatatattggcagaagaggggacgcagttaagcgccccctttttcgctaaaagtgcaggaccggaataggaatacagaacggggcagtaagaaaaaagctaaggaacataagtgattttcaagtaatatcagatagaggaggagactctgcagtgaaaaagaaaattaacattgacggcgctcagaacgtagaggtgtcaatcccaatcccatgtgaaaaaacaccgcgggagcagttgtctattatggaagcctatacagaggcgcataggaacggtgaggggctggataaagcgagaagagagattaattgcttaaaaacaatatacccggttttgttccgttcgattgaatgtgatgatctgctggcaggcagacttgattttttgcccattggctttggcagtgtaacaagtatcggaggcgtaggccattactgcgtattccataagctgagggcgtttaaagaaatgctgtccaccgaagaggaaaaagcaagggttgatacgctttacaattactggcaggatcatgatacgaaagcaatttactgtcaggaggtattgacagaggatacagtcggaaggtttattgattgctcctatcctttgatggcaacagccaggttgtcgggaatgatgttgaattataaaaagctgatggaatatggagtggaaggcttaaaggaactgatcagtttaaaagaacaaaatgaattcctggaatgcagttatgaaagcctttgtcttttacaggaggtaatggaacgccagatggagctggtgagagaagcaagaaacggtgcggaccagacccgtttgaaggatttggaactgatggaaaatgacttgcggtatattaagaagaataaaccacgcacgttccaccaggctttgcagttgttttggatctacgccctttgtgccggagtaattaactatgggcggctggatgacgtgctgggaccatttttgcagcatgatctggatcatggcgttattgacgaagaagagtcttacaggtatttaaaatccttgtggaagatgattgagaacaggcgtaccacggttaacggacgtattattgtaggcggtgtaggacggaaacatccgaaagaagcagatacatttgcccgtatctgtatgagggtgtgcaaggatacacgttatgtggaaccccagtttaccctgcgttttagcaaagacactccagaatccattatggatatggcctatgattgtatcggaagcggtgctacctaccctactttatataatgatgatgtgaatgtccccgcagttatgtattccatgggtgtgaatcgggaaatcgctgaacagtacgtaccatttggatgcggtgaatttgtcattcagggtaagagtgtaggaacgccgaatattttattaaacctgttaaaaatcttaaatatcaccttaaacggcggaacagaccctatggatgggaaacgaaaaagcggaccagtggagattccggaatgttcccagttcaaaacctttgacgagctgtttgataaatataaggagttattgaattattactttgatttaagtatacaggctcaataccgttcttatgagatcatgaatgaaaaagtatcctttctgtttacttctgttttgatggatgattgtatcaatcgagggaaggcagtgctggacggaggagtagaaatccttggcggaactaatgaaacatacggaaacatcaattccagcgattccctatgggcgattaaaaagctggtgtatatggataaaaaatacagtctcagtgaattgcaccaggcacagcttgccaatttcgaaggatatgagaggattcgaaaagatttattggatcaggataaatacggcaatgacaaaacggaatgcgataatctcgcaaatgatttatttgaatttgtagccaaagggatccgccagaaggggattgattatggcatgggatattttctgatcgttatttcaaataaccagactaatacagattggggccatgggacatttgccagcctggacggaaggaaaacaggtgtttatttgaatccagctaataatccccagggcggagcagctaaaaacgggcctaccgcctgcttgaattcactggctaagttccaggcaaaatatcatgggggaagcgtgcagaatatcaaatttacaccccgtatgttcaataaagacagaaaaaaagttaagatgctgtttgatacatactttaagaaagggggatgccagctcatggtaacggtggtggactatggcgttcttgaggaggcacaaaggaatccagagaattatccggatttaattgtacgggtggccggttacagtgcggtctttgtgaatctgacaaaggatatccaggaagaattgctgagcagggcattgtatgattagagtgaccaatattgaacgctttgccacccatgatgggccgggaatccgcaccaccgttttcttaaaaggctgccccctgtactgtccatggtgcgccaatccagagacacagacatcttatccggaactgttatacaacgagtcgaagtgtatcgggtgccgttcatgcgaaaagggatgtgggactaaggctattacctttgatgctaacggagcgttccattataacaggaacttatgtaccgattgcctggcctgtgagaaaaattgtatgcgggatgcaatcgagttttatggaaaagatatggaactggatttcatcatggaagaagtgatgaaagataaggattactatgataattccgacggcgggggaatcacggtcagcggaggggagccctttgtacagctggaggggctgatcgccattctcaaagcaagtaaagaaaggggattgaatacggcggtagaaactacggggaattattctttaaaaaccttgcaggctgctgaaccctatatcgaccattttctctacgattttaaacatctggatgacgaagtacttaaaagggttacaggaggaaatgggagacagattaaagaaaacctgatatatctggtaaaaatgtgtccggataagttaactgtgcgtatgccgattattcctggattcaactttgactctgcattaataaaagagactttgctatacttacggcagctgggagttaaaaacataaatcttcttccttatcatacactgggaaaagcgaaatacgagaaattaggaagagtttatcagatgactggaaaaatgcttcatgaagaagatttggaggaatatcaccaatatgcgttgaagattgggctggaatccagaatcggaggatagaagcagaaagacaggaaggaacgtgatatgagttccttcctgttttttacattaaagtcatcaaatttatgtaaaatagtccatgtccaataggtcgtcatcgctcataatgcggacttcatcataataggaggatgacagttgtatttttgcataacctttttgtataattcgtgcaaagggcggaatgctctttcaatggtaaaaacacagtggcggttcgtaacatcaatgatcttaaaggaggtggaagtggtcctgccgatgaagtacatgttgccacaggttggacagcagcgggagtggtagcaaaaagcaacaaatttaaagttgccgcatctagggcaggaatacatggctccaccaaaggcaggatcaccgtagtgaatcatttctttaaactggttaatatagatattttgttatctatggcaggctacgtgtattggaaaaaaggtaaagtggtatgaggaaaagttcaatagttcaatattgcatcagaaaggttggggttatataaatctgtagctactggtataggagtttatgaagaatagatgttatccaatataaaaaataaagcttgcacaagtgaaagaattatggaacttatttgggtgataatgatgaaaagcctgattctaatttcaaccattatgggcttggttttataggctgacaggaagtgatttatttaatgatgtatctggtgtaatggcaatggaatcagagaagcaacagaaggtattggacaaaaagtaatagtgatgctaagctattgtcaatatactaacaatagttgccttatttaggtgtggatatataccatactttaacacacttataatacaacagattacgggaaaacaataaaaaataaacgcatgtactgataaaacggtactggatttaaacgaggagaacatattgatgagttggggaatttgcatattatatttttctggagtaggaaacactcaaatggttgctgaggctatatatgaagagttagataataaagatagcgttgaaatacattcaattgagagtttgccaggaaattttaatataaatcattatagtaagattattataggtgcgcccacataccactcaggtccagcactgccattattgaattttttaaagggaatttctaaattagaaagaccggttcctgcgttcttatttactacatgtgggctctattctgctaataccttgaggataatggcaaaggtatgccaaactaaaaatattgtttctgttatgagcagcagttatcgctgttcagctactgatgccattttgatggtgccattaataaaatttttttctaggcatgaaaagaagctttggaataaaattaaatatgacgcaaataaatttaattatctaaagcaggttgacttacaaattccccgctttaaattatatagtattttgaattatccgaataaatggatgggacaacgactatgtgtcaaaatacgtttgcataaaaacttgtgtatacaatgcaaaaaatgtatagtaaattgtccccaaaagacaatagaaatagatatggctggttttccaagatggaaaagtaataattgtattaactgctacagatgtatccatcattgcccccagcgtgcattatctctatcagagaaaacaacccctaaaatggtttggaaatagaaaaaatataaatattttcatataaacaaaagatcttctatgataattttcataggggatcttttatttgttatacagagtcctaatataacatgattaccctttataagcgttgtaatggaagtaacacgattacatgccatttccgagacaattaatgaaactattatcacttgatataaaaacttgaatggtgaactttttatataggttaggagaattgactatgacttttactccatgcagggtaatgcttccggattcaggaaggtttgttttgcatacaggtttacgggggaatcttatgatagcgggaggctgattccgtgccaaacgcaggttttctgttgtgaataaggcactgggcagggaaaaggcgaaagcctcatagcttattcagctgaattcttctcgttttaaattaaactgctttctacgaataaatatatgctctcctatctgctttagtatttctttcatttttaaccccgtaccatagaaagattttatctgctataatatataaagcaactatagtattttattaacctatagtatgcatgattacgtcaaaattagttagaagagttgatttataattaataataaattaaaatataaaaaagaaagagggagggggaaacaataatggaaacttcccaaagtgttatacaggtggcaatctgtgatgatgaaaaaataatatgcactgaattggaagtttttattgctcattcctctatgtagtattgtaatgatacattatttaatagtcacccgccgccctatgcatgatgtcagggtaattgaaggtgcaggtcttttgattatcaatataataacgttttatatctatagtgcagttgaagaatcttatctagaaaatatggataaagaaattgcagttcagacctctataatgtatgcaaaccaattagaacttattatgagaactcagcaagagataaggtctttgcagcatgatatgaaatatcatataagggatttaatgtcgatggcaaaggccagtaattctaaagatattcttagctatcttgaaaatatgagtgaattagtcgataatccaaaagagttagcctcttctggaaacaaagaaattgatagcaatataaattatcttttaagatatgccagggaaaaattaattgatgttaacatcaatttaaaaatacctgaggttttttttgattcttcctatgacataagtgtaattattggaaccttattggaaaatgctattgttgaaacagataaaacagatgaaaagatgttaagcataaatatggtaatggaaacatctatattatatataaagattattaatacttataactgtatcataaagaagaggggagataaaattttaacctcgaaagataattcggcatatgacaaaaacatttttcgggttgttattatgttatatctaaccgatacgatagcataatttattgatttatcaggctaaaaaggaattgtaaacatttaataaaaaacatcgctttttatgggaattccctgaaaaacggtgtttttttgtatctttagctgaccactcccaagtgttatgtactatggtttgaatatctgaactgctttgcattgagaatactagtgttgaaaaggatagcgctcactagtcagtcagtggtcatggcaatccggattcccatgactacaaagcctattgttatgtccctgcaacagcgatcattcaaatcctgatgccattaggaatattgatataaagaattttctggttcagtttaaaactacttttggcagaagcaaaaggaaatcttttgttctttcctaaacaggtaaaaaattaagacggcagtatttttatataaggctaaatatgaacagagaagcgaagacagataaagagggttctggcattcagcaatattttttgacagaattgtcaaaaatatagaatatacaatattttatttagggtatttgttgtaaaaaacacagcccaaggataacctttacattaaaattgctatcctatattataaaataaactagtggatattaaaagaatggagtttagctatgtttcaaatcggaaagcgggaaatcgaacttctttatctggtaaattcatcgaaggatgggtttatttacagagagttaatagagagatttggatatacggaacgttcttttaaatatgctgtcgacttaatcaatagttttctgaaggaaaactctcaacaggcctgtttcgtacttgataataaaagatgttatttaaaaaaccccctctttccatgaagtttacactggatcacatcacaaaagaactgtattacctttcaaaggaagaccgcagtgaaaccatcttctttcggtatttggctgatttacactacacaatcgatgaaattacagactatctggctgtgagtaagtctacggtaaagaaatcccttgcagttgtcaaggaaaaatgcggggaatatggtctggagcttgtaaaccataagagaatggggattgagctgaagggaagtgaaacggtcatccgttcagcgcttatggatttgctttataaatactgtgctctttcaaaccaggacagtaaacacaggaggcttgctcttcgcaactgcaatccttatttaagagaatggatcggagcggtttttaaccagtttcaatcagaacagaaagcagaggccttattttcctccatatgggaatatcttccggttattcagaatgatgaaatctatatactggccatggtgaatctgatcctgatattttacagaacaggaaacgggtgttacgtttcagcagatacagaagaatacgttggattggaagggagaaagctggcagaagccatcagcatttcctgtgagaaaaacttaaagatcaaactgccctgtgaagaattttttaaatttgtcattgttctaaacaagggttattccatagaaagcaacgaaaaagatcagtatctgttaattggaagtatgatctggatccatcgccttgtttctgatttacttcaaaaatacaccaaccggtcctttcagtcattatcaaatgaatacagcttaaacgaggcgctggatatgctcaacaaccatttctacgcagcagtggagagagtaaggcgaaatatttacattcagaatccaattcttcaggacataaaagaagaatacagagaagcgtttcatgatgttgaaagcagtttagaagggcttgaaaattatctggaaaagaagttttcacaggatgatatcggctatttcactttgctgcttgaaaatattatttcacaggtccgcaaacagaagaaaagagtacgcaggattgttctgatctgtggcttgggctatggaaccgctcagatggtgaaaaataaaattatgcagaagtttgatgtggtgatcgaagatgtgatcccttattataagctggatgcttatgtggataaccagaatattgatttgttcgtatcaacagtccctgtaaaaataaatacaatcagcaatgtggtggaggtgaatccgctgctgacggagcaggatacagaagctttgataaaagctggaatggtccgcgggggcaatgatttatccgctctgatgcagctaatagaacagaatgcagtgataaccaatcgttcccgtttggaaaaaaatttaaaggaattatatggaatcagagacctggaacattctaagtatgagattttactgaagtttctgcctgaaaccaggatccttgtcaatcagacgtatcatgactggcaggaagctatctatgctgcgggcggccttctggtagagacggattgtgtcttaccgtcctatgtggaggatatgatcaataatatcaaagaattcggttcttatatcaccattggcaacggaattgccctgcctcacgccagaaataaaaataacgtgaaaaagaccgcattcagtctgattacattaaaagagccggtggtatttgaaaatgggaaaaagattgatacggttatcagcttctgtaatgttgcaggcaatgagtatacaacagcactgacagctctcatggagttaagtgaaaaccagtccttcctggactataaaaaagaggtgaaaacgccgaaccagctattggaatatataaaaaaattaaagtaggtgaattgtatgagtattatcaatgaaaaatgtattgcattaaggcttgatgcctctgatgcacaggaaggaattgtaaaagccggacaggtgctccttcaagaagggtatatcaggcaggggtatattgatgcaatgctgaaaaacttcgaaaagaacggtccttattttgccattgcacctggttttgccatgccccatgcaaggccggaggagggggtcattcaatccggaatatccttaattacccttaaaaatccggtttcttttggaagcagcaatgatcctgtgaagctgattatggcacttgcaaccagcaatgacaatgagcatcttgagtttatgacgaaaatagccggacttttaggcaaagaacgtgtgatagaaaaactgtatcagtgcaaaacaactgatgaggtgatgtcagtgttaaacaataattaagcaaaggagatgaaaatgatgaaagtattagcagtttgcggattgggaatgggatcatccctcatacttcggatgaatattgaggaggtttttcagacagagggagtaaaagcggaagtggaacacagcgatgcttctgcagcaagcgctgaagcatgtgacttcattgttacaacaaaggaaattgcacagtcccttcagaatccgcggggaaaagtaattattctggataattttatagacaaagaagaaattaaaagagttttaaaggaaaataatgttttctaactacctacggaggaggtttcgttatggcagctgtgaattggattgcaactaatattttcgggaatgccggctttttattaggaattatcgttatgttggggttaattctccaaaagaagtcattcagtcagacggtccagggaacgattaaagcgattattggttttcagattataggaatcggttcgggaattgtggtttcttcattaaatgtttttcagcctatgtgggctgaggtttttggactggaagcccagagtcttggtacttacatggggcagaatgactttgttaagaaattcggtaccgttgttaccctttctatgacattcggatttctgatcaatgtgctgctggcacgtttcacaaaatttaagtatatctacttaaccggtcatatgatgttctggacttctcttatttttgcaggaatcatttttgatcagaatatcaatgccaatacatttgcagtaatagtatttttatcaattgtactgggcgtttattggacattacagcctgctttgacacagcctttcttaagaaagatcacgggaaatgacagtgtggcactgggacatacatcagcctctgttgcatttttaggtgcagtggccggcaaatttgtgggaaataaggacaagagcacggaagatctggttatctctgataaatggggattcttaagggattcaaatattgttaccggaattaccatggcagttttgttcatcattggtaccgttcttcttatgatgaaacagacagagggtgccggagagattcttgcaacctcaggagatacaagctttatcatatactccatattaaccagtttacaatttgcaggcggtattgctgtggtgcttttcggggtccgcatgtttattggtgaaatggtacctgcttttaagggaattgctacgaaagttgttccaggtgcagtacctgcccttgattgtcccattgtttatccttatgcaccaaatgcggttattatcggattcctgggagcatttgtagcaagcttagtctggcttgtggttttaggaaataccgtaggctatgtgtttgttccaactatgattgctattttcttccatgcaggaacagcaggagtctttggaaataaaacaggaggaatcagaggtgcgctgtttgcaggtgtgattactgcaactgtcattgcagttggtcaatatatcatggttacgttcctggctccatcgacggttcccgatgtggtaatgtgggctgctgattccgatatgtttatcattgggccgattatccggttcattgccggctttttattctagggagtgtctgaaaactcattgccccaatctgcgcgctccactttgcggcatatttgctccaaattcagttggcgtagcccactacgccgccttcatctggaacaaatctcccacaaagtgtaatgcacatcttggaacaagcaattttcagacacaccctaaaagaatatgattttaatggtatagccggagttttttttaaacttacggctatgctttcccgtataaatgcatggacagacaggaggaattatcatgaattttgtcagaacgattttcggtgatatttcaccggaagaaatgggagttacttattcccatgaacatttgttgtgcgtaccgccttattggaaggagaaaaatgcagatgacctgcttcttgatgatcctgaaaaaacaaaaggggatatgcaggattttaaggatttaggcggctgtactattgtggatgctactgccattgactatggaagaaatatttccggagttgcagaactggcaaaagaactggatattcagatcattgcaacagcagggtttaataagtcctttttatgggatgcaaagctgccggagcatttaattcccattgtaggaaattatcatacttaccaggagtggatggaacaggcaaccgttgaccagctgacggatcacgtaatccgtgaagttgaagtggggctggaaggaacgccttacaaagcagggcaggtaaaaaccggtacaggctataacagcataaatcccttagaggtcaagactattgttgctatagcagcagcccatcatgagacaaaggctcctgttcatctccatacagaggcaggaaccatggcgctggagcagattgagattctggaaagggaaaaggtggatatcagccgcgtttcctttgggcatatggaccggaacctggatttatattattatgagaaaattttgtcccacggaggatttttaagctttgacggacttgggaaaataaaatatgcaccggagtctgcgaggattcacgtaattttggagctgtgtaaaagagggtatgaagatcaccttttgatcagccatgatctcgccagaaaatcctattacagaaattacagctacggaatcggcttaaagttcatattagacaagtgggtccccagattcatagaggaagcagatacagcaggcttagacggaagggctctggcagataaattcctgataaacaatccaaaagaatgcttcacctttcgacaggaggggggaaaatgagcaataaaatgaatgaactggatggaatgtcggtcagagacttaattccaacccatgatatcgccctgctcccattaggcgctgtggaaatccatggtccccacctgcctataggcacggattcctttctcgctgaaaggctatgtgaaaagctttctgagcgggttccttccctgatccttcctgtgattcattacacccaggtctggagtctgggagaaatgaaaggatccatcagtatcagcaatgagctgttgacacagctgctctgtgaaattctgttggaaacagagcgaaacggtttccgtatggctgttatgatcaatactcatctgggaaataacggtgccataaaggaagctgccagaaaggtactgaaagaaaaaccaaattttaagatcctgtatttcacctatcccggtgcaggagaaattctggggaagtgatgggagcagggaactttcacggtggatttttccatgcagatgaaattgaaacctcgtatatgctgtatttgtgcaaggatcatgtggacatgtcaaaagcagtcaatgaaactcctctggtgcctgaactcatagacgtgacgcctatccggtggagcgaatttactcagaccgctgtcatggggaacgcaaaggatgcaacagaggagaaaggccgtaaagtcatcgaatatgtgttggaccggatggtttctctcgtggaaaaggcaaaggaaaggtgattcatgaacggtattaagacttattttaaaaatattgaacggattctggattccgtactggaaagccagggagaggccatggaagctgctgcaaagtgctttgcggatgcaatccggcaaaagcgttccatctatgtgttcggctgctcccatggagctattttatcagaagaaatgttttaccgtgccggcggcctggcagtgatcaaccctttgtttaatccttctcttatgctcaatgtccgcccggttactctcacaagcagatttgaaaggctggaaggtcagtcaaaggctcttcttcaagagtccagtgcaaaagatggagatgtgattctcattcattctgtttcaggaagaaatgctggaattgtggaaatggccctggaagccaaagccaagaatatgactgtgatcggaattaccaataaggcatattctgagaagagtacttcccgccacggcagcagaaaacggctttttgagctgtgtgacatctgcatcgacaatggtggagagtttggagacggctgtgtttcaatcaaaggaattcgggaaaaggcaggagccacctccactgtaatcggagcctccattgtcaatggcatttccgtcagaactgctgaaattctggctgaaagaggaatcaggccgcctgtccttcacagtgcaaatgcggatggaggagatgagatcaataagagaatttttgaagaatacaaaggctgtattcactatttataaagggagtaaatcccgatagagtaaactgctgcgggctgatttgtttgtgcctgcagcagtttttttattatgggctttggctttgtgaatatggaggattttctctttagctgcatcagtattgtgcggctttttcaatgtacaattctggaactgttcctatacctcttcggcgtcatcccattatgcctcttaaaaaaccgggtaaaatggctctcatcgtaaaatcccagccgttcgctgatctctctcatggacaagtccgaattctgcagcaaaaagcaagccctcatcagccttagcttactataatactccaccgcactgcatccaaattcttctttcaccagccgttccagatgcgttttgctcagattcaaatatctgcacatctctgccagcgacatgttcagctcttcgtcatgagcgatcatatcaagaaacttgtcccgaaaattattgttgggggactcggaaacttcctcaataaaaagcagtaccagggattctgcccggttctggagcttcagaaggttaagccttgtcaagtcatgggagcctttcacgaatttgtcaaaccggtcagagcggatatgcaggttttgtatgtggaagccggttggaaaggtctgtttcaacagcgcgcacatctcataatgctccggctcatcctcaacatcaatacctatctgtgcatatcccgttttagaacttaacgtatggggaagataaggcggcagaatcaccgcctgattttcatgtatggaatacgtctgatttttcaccattatatccaatgtccccgaagtgacaaagataatatgaaaaaagctatggctgtgcagactcagggaaaaatcagccggcctctccagcatatgaatcagccgcagaggcggcttcaagtcaatcatggttcccacaatactgagtttctccatcttcacatctttcctttcaaaaaagaagcagtaattatgtaaaaaataaatggtctgaatatacaaaaacgtggtccgtttttgaattgcaaaacatctgatattgccttatatttataataaattaaagaaattaaatgtcaataacaaataatcattttagaggagaaatatacaatgaaaggtattttagatgcaaccaatgtcaggatcaccagactatcgcccaaggatgggaaacaatactttttcggctattacgacattcctgcatttcatccatataaaaaactgcatctttgccatcaggtgtccttcatggaccgcctgcccgaacttaaggatgtctgccgtctgggtgtgctggacatggggacgggggaatttaaagagctggcccgaacaactgcctggaattttcagcagggcgcaatgctgcagtggaaccccttaaattatgaagaaatcatctacaacatatatgagaacggcaattaccggggaatgattaagaatatcaagaccggagctgagcgcaggcttgatcgtccagtgacaaacgtttctcctgacggccgctggggcttgtctgtcaacatgagccgtatctatgatttccgcccaggctatggatactgcaatcaaaaggatccattggccggggtgcacattcccgggcaggacggagtctttctgattgatatgcaaacagggcagtcaaagctgatcttgaactaccggcagatcaatgatgccctgccccagccatggtctccgaataaaaagatcgtcattaatcacatcacctttaaccgggaatccgaccggttcctgttcttggtcagagtgtttcctgaggcagatggagaatggaaaaccgccttgggaaccagcgatctgcacggtaatgtctatcctttaaggccttacgcatatgcgtcccattatcactggggcatcggtggccgcctgatgatctacggcggctggggtaatggggccggcttatatattctgcaggatgaaacgcagcaagaagagcgctatgactctccattgtttcgtaaagacatacactgcagctactcgccggacggcgaatgggtaatcggtgacgggtatcaggacgaaaaagagtatcggccagtatatctgtaccatatcgaaagtaaacaggggatgatgattggcagatttcattccccttatccccctattacggatattcgctgtgacctgcactgccgttggtcaccggagagcgatacggtttcttttgattctattcacgaaggttttcgtggcatatatagaatggaactaattgatgcaatgaaagaaataagaaaattgggaggaatttgaaatgaggaaacgtacaacagcgatgctactgattacggccatgctgattactgcctgcggcagcaattcagctccgcccggatcaacggacacgaaaggggaaacgccggccaagtctggggctgaccaggataccggcacatcagcggcggccgttttagatccggtcaccatcaccatctggtatgagggtaacgactcccgcctgccattcttcaaggccgctgaagccgagatgcagaaggaatatcccaacttttccatcaacgcggttacctttgacaacgcgacactgaccaccaaggcgctccaggcggtaaccaccaatggcggagtggatctgatctttaatgaggcctctcgtctgctggtcacccatcagcagtccaacggcggctttgaggcactggacgatgttttggctgcggcacccaatcaggagaaggtaacggatgcggacaaaaaggttatttctgccaatggacagatcatcgcgttccccatcaaccgctcggtaaacggactgggatataagactgatgtgcccggtgtggaagttacggcagagaaagttcctgacacctttgaaaaatttgtggccctgggcaaggagtatcagctggctggaattgccggttggaccctgcatctgggaaccagtccggatcagatctttaatctctttataaccggaggaaacggacagaatgatgtgtggattaacagcgtaccagagagccagattcagaaaaacgcgaagtattttgagcagctcatcggcctttactccggtcccgatgccatctgggacaaggatgcaattaatgaggatttttccgcaatgtataccaagatccagagcggaagcgtgggcatgttccgggtcggtaactggaacgcggccggctgggatcagccggacagcggtgtcggagaatacgaggtgaccacttggccgtccttagacaacagcgggaagggcggactcttcctgggcggagtccggggactggcgatgccgaagaacgcgccggagaaagaggctgctaaggtattcttatcctactgtctgtcggaggctgctcaaaaggccagctttgataccatgggttcctgtatggattatgatgtggtggatcagaatcagctgagcaagaaccagaaaatattctttgactcctcgattcccatctatccaagtgattcttatgttggaagctttacgtattatcccgagctgctggaaacctacgaaaaggggctgaccggcgcctatcaggcaaaggatgaggcagagattaaagccgcggtagaaaagctgcatgaggatctgaacagagtgattgagcagaacaagtgaggtgtttcatgagatcacgaaacaatctggcctcccattggaaatggggggctgcgttaaaaaaatactggatactgtatctgtttatcggcctttttggcctgctctcggtcgtctttggcgtttatcccatgttatccagtatcttttattctttttttaagaccaatacggtattgacgaagccggaatttgttgggctgggcaattatcttaagctgtttcaggactcctacttctgggattccctgagggtgaccctgttgtttaccgtcatctgtgtgcccttaaatcttgtggcggcattggcgctggcccagctgttaaactatcatgggctttcttctccagcgcgcctgctctttaagctggcggtatttatcccgtttatcacgccggacgtggtcagtgcggtcgtgtggaagcagttctttaacagcaatggtgcgatgaacagcctgcttaagctgctgggaattccgcctcagagctggctgaccagcggcggactggcaatcgtggtacttgcctttgtggagctgtggaagcatgtgggcctttacactattatttttctaaccaattatcagctgatcgataggagcatgtatgaggcggcaaccactgacggcgccaatggctggcagatgtatcgctacatcaccctgccctccctgcgccctgcgctgatgctgaatctggtgtacgctgtgattcagtttatgaaaacctatacggtgtccaggatcatcacgttcggcggtcccaattatgccaccaattttctgtcctactatgcatacagcaaatacgaaaaaatggacttcggcatggcgacagctattgccacgttcctgttcctgctgatcattggcctgacatttgcaggctcatggggaaggaggcggttcaatgaaagcaaataaggtggttaccctgttggtttatctgattttggccctgatttcatttataatgatttatccctttttgtggatgcttttcggatcttttaagaccaaccaggaaatcattaagtaccctctgtccctgttacccaaacgctgggtgctgtcgggatggcaggggatcatgactttgtcgggcaatcccattgggcattactttaaaaacagtgtgatcatcgccggagggagcacgcttctggtggtgcttgccacgtcactgggtggttatgccctctaccggagagctgatctgccggcattttctgtgattgagaaatctttcagcttaggcctgatgtatccggcggtgctgctgctcattccgctgtatgtgatcgtggtgcagctaaagctgtacggaaccggcaacttctggggaatcatctttgcctcgtccacaggcgcgtggggcgcggccctgccgtttttcctgtttaaaaacttttttaagtccctgccctatgatctgatcgaatcggcaactctggacggggccggggagtttcagctgtttttccggattgtggtgccggtcatgtacccggtgtttactacggccacactaatttcttttttgtccagctggggattatggcttccggtgctgatgctgtccaaggatatgagcacttataatctggcagcaatgctggtaaacttaaattctgacctgggtgttgatatgtccatgaccgcagccttatccaccacgatttcacttccggtggttttggtgttcctggtgactcagcgaaaggttatggatgggattgccgcaggcagcgtaaaaggttgattgataaaatgatgaatgcagagggaagaaagaggaatgattatgaataagatggaacagaattatgacagtatcctgaatctggattttgacaggaagaacaggatttctttgctcacggccagggattttatctttacccataaacgccgtcgggaatcgctggatggagagtgggggttcactcctgacgtgtttcagaccataaccagaaaacaactgttttcggccctggataaggatgaccaggggagatatgtgcccatggatttagacttttctcacttagaaaaggtgtcagtgccaggatgttggaactgtatccgcgaccaatactggtattacgagggtgaatccgcctatttcagaacctttatttacgaaaaggagcaggagggagaacgggtattcttaagagttggggctgctaattacgagtgccggatctggctgaacggaaccctgctggccagacaccagggtggttttacaccattttgcgcggaacttaccgacgaactggcgggagagaaccggctgatgatcacggtgaacaaccgcagggaactggatcagattccatccatgaactacgactggttcaattatggaggcatcacccgttccgtggaattattccgtctgccccaggtgtttattcaggactttttctgcagcctggtcccggatacaaactttgagaagattgaaatgaagattactttgagcagcgcattggctggacaaaactgccggtttttcatcgaggaactggggattgatgagccggttttcactgatgagaacggggaagccgttcttcgcgcttcggcccgtccggaactttggagtcctgagaatcctcggctgtacacggtggcagcggtctgcgggtctgaccgggtggaagacctggtcggtttcagggagataaagactcagggcaagaaaattctgctcaacggacaggaaatttttctgaaaggtgtttgctgccatgaggagagccgggctggcggccggactttgagcgaagaagagcagatggatatcatccataccgccaaggaaatgggatgcaatgccttgcgtctggcccattatccccacagtgagaaaatgtcacagctggcggaccggtacggtttgctgctatgggaggagattcctgtgtactgggcggtggattttactaacgaagaaacgtttctgaatgcgcagaatcagctgctggagctgatgaaacgtgataaaaaccgggccagtgtgattatctggagcgtgggcaatgaaaatccggatacagaagaacggctgagcttcatgaaacgtctgattgatacctgccacgaatatgatccatcacgtccggtaagcgcggcctgcctcgtggatctggataccatgtcagtgaaggatcgactggccgcgtttgttgatatcgtctcgtttaatgaatactatggatggtattaccgggattacgagggtgttgccaggatcctggagaacacggtcattaacaaaccgctggcaattactgagaccggcgccggagccaggaccgggcatcacggaggagcggaagagcttttcacagaggagcatcaggagaaagtatacagaaagcagattgaatacaccatgggcagactgcagggattttttccgtggatactgtttgattttatatcaccaatccgcaagaacccgatgcagggcgggaaaaacagcaaagggctggtggacatggataagaatagaaagaaaaaagcgttttatgtaatgcaggagtattatcagtcaatggaataggcttggaaacttgtttagaaagttaaagaacttttcatttatcatgactccttaaattgcaaaatatgtgaatatgacaaatagagtgcgtttccaggattggagccgcactttatttgtatcattatgaaatcaaagcagtaacatattcaatcgcaaagagagggggaataccggcttgacaaattcataaaactcgtttacaataccggttaggcaaaactaactaaggagtaaggaggagtcgtgcgcaaatttatctggttaaaccctgtggtaactaaaatgtatgtaaatgaaacgctggaaaagtatttggtggaaaaaggttatgagccggtgtcctgccgggaagatcatattgctgcagttaaggggaaatacaggtctgccctagacagagcccgcacctgtatcgcagatgtccgatgtcccatggctgtagactacataaaagaagtatattctccggattttctggaatttccacctattgagccgattcttatacactgtgccagagaactgcataaaaggctgtccggtcagggagctttatggatcatcacgccctgcaaggcgctttctgatttgggaagccgcatcggactgccagagacaagtttttgtacgtggaaagaatttgcccgtttagaaaatatcccgttacttggaaagaaactggctgatagtccgattcctccgggcttttttagcggtcatgaggagcaggtggtcgtgttggatgacagggaaaaaatcgatctttacttttcctcaattaaccggaagtccgagaaagggatcgtggagcttctgtactgttccagagggtgtcatcatggagacggggtatagggagagactatgagaaaaatgtggaaagcagctttgccacttggactactgtttctgctgtggcagactgtatcgggtatgggaatatggagtcaatatattctgcctagccccgaacgggtttttcaggcgtttctgactatgattcagaacggttcgctgtttcagcatattacggtcagtcttctgcgggtttttaccgggtttataatcgcttttgtgctggcgctcctccttggggtcctggcaggagtgtatcctgcaaccacgccgttttataagcaccttgtggaatttatgcgtaatgttccgccgttaagcctgatcgcactgctgattctctggtttggcatcggagagacatccaagaccattattattgtccttgcctcctttttcccaatgtttctgaatattaaaaaaggacttgcagcctgtgatgtcaaacttttggaagtaggatattcgttaggattttccaaaatgaaggtcttttttaaaatcatgcttcccaatgcacttccggatattcttgtgggcatgagagtgggcctggggtacagctggcgcgcaatcataggtgcagaaatgatcgcggcctccagcggtctgggttatatgattctggatgctcagcagatgtcccgttctgataaggtggttgtggggatttttgtgataggtattgtgggctatctgtgtgaccgtctgctttccctggcgatccgcagaatattacatggaggtgtggatgacagctggagttaaaatagagaagttatgcaaaagttatcaggtggcagagaatcgcatgaaggttctggataacctgacggcagaatttccgaaagagagcataacggtgattttaggaagaagtggctgcggcaagactacgcttcttcggattctgggcggattggagccctacgacagcggcaccctggatatcccggaccatggcaagattggtatggtttttcaggaaccccgcctgatgccctggcttactgtctggaaaaatatagggttcgggctgccccaaagacgcatatccgtaccagatattcaggccctgatccataccgtaggactgacaggttttgaaaaggcccgtcccatgcagctttccggaggtatgcagcaaagggtatccctggcccgtgcgctggcctataatccggaattgatcctgatggacgagccctttgccgcattggattattttaccagaactgtcatgcaggatgaattgatacgtatttattccctgcagaaaaaaagcattgttttcgtaacccacagcattgatgaggctcttttaatcgggcagaaaattctggttcttaagcagggaagtgtggaacaggaaatttctttgtcgggctacacctatccaagagatcttctttcctcggatcttatagaaattaaaaaaaatattataactacattatgacaaaggagcgatatatgaaattgaagcgtattttatctatatttatgtccgccttaatcggcgtttccgtattgacggcctgtgccggttcgtctaatacacagccggcaggaacaggagccccggcaaactctgcagaatctacggaagaggaatcagaaacggcagcagaaacggatcctcaattcaccgtaagcaagatcggtatcacctatgtaaaatctccgttgaatgtgccgtctattgtggaaaaggaaagaggaattttcaatgaagtctattcccaatatggacttgaagtggaatactccaatttaacaaccggtccagagcagacacaggcgctggcttccggcgacattcagtttttgtatgcagttggtgccacctccgttattttgtctgcagctaatgatgcggatataaagatcatcagcacctacagccgctctccggaagcttttcggctgttcactggaaaggacagtacgatacagaccgctcaggatttaaagggaaaaaagatcgcgggacccaagggaaccatcctgcatgagctactggctgcatatctggcagcagcgggaatgtcggaaagcgatgtggaatttgtttcaatggggattcctgatgcacaggcagcgcttgccggcggtacagtggattgtgctcttctggcaggcccggtggcttataatatggaaaaggacggttaccgcatcgtgaccagcggcaagggacttgttgatgccattatcgtagtcgcgaccagcaacgaattctatgaaaaaaatcctcttttaataaaaacatttcttgaggctcaggataagatccaggattacatgaaagataacccggaggaaatcctggacattacggcaaaagaaactgaactcagcattgacgccgtgaaagaaatgtttcccatgtacgattttaacacggaaataacggatgatgatattgtatcaatgaagaaaacagaacagtttatgagagagaatgggatgattgaaacagaagtaaatattgaggatctgattctccgcttgaaataaccatagaagaagagcatttaaaaggcacgtctccttagatggaaaaggcgtgctttttttgctcaagcaattaaatttatattacaaaattctcttgacaaagcacatgaaacagtataagctattaacagtgttagttgtgaatgctgatacccgtttgaaagctggaggtgaatagattgagcagtatagaagaactggttgattcattgagtgaactgatgtcccgtggaaaagtcatggatgaatataatcgttctggaaaaggtgaaattttcattttacgatatctttatacgaaagaagcacctgcatcgccttctgaattaagtgaggcgctatgcagcagtacggccagaatctctgcggccctccgtaccctggaaaagaaggggcatattcaccgtgaaatagacaccacgaaccggcgctttattctagttacaataacagaagaaggccgtgagcggattcgtgcaaacattcagcgaatgcaaaatcatttgattcaagtgttaactgaaatgggtgaaaaagacgcaagggaatttgtccgcctttccatgcgtttctttgagattgcccagagcaccagacctgatccttttgaatagaataatgggaaacggggaataagaatagtaaaataagaatgcagaccaaacaggtctgcatttaagggacggatatctaacagcgttcaatatgaacagtaataataaggaggcttttttctatgattagaatttttaaatatctcaagcccaaagaatggctgatggcttttatcagtttggtttttgtggtggtacaggtatggctggatttaaaatcgccggattacatgtcagagataaccatgttagtacaaacgcctggtagtgccatgagcgatatttggcttgccgggggtaagatgcttctttgcacactgggcagtttggcaggcgctgttatcgttggcttttttgcggcacggattgccgccgcattttccagacgtctgcgcagcctgctctttcataaagtggagtccttttccatggaggaaatcaaccgcttttccactgacagcctgatcacccgttctacaaatgatattacacagattcagatgttgattacaatggggttaatgctgattatcaaagctccgattatggctgtttgggcgattaccaaaatcgcgggtaaaggctatgaatggtcacttgtcacaggagcggcagttgcgcttttagttgtcatgatcggtattatcatgatctttgtgatgccgaaatttaagaaaatgcaggctttaacagataatatgaaccgggttacccgtgaaaacctcacaggacttcgtgtagtaagagcttataatgccgaggattatcaagaaaagaagttccgggaagccaatgaggaattaaccggtacccagttgtatacaggccgtgctatggcaattatgatgcccattatgtcaatgattatgagcggactgtccctttccatctattggatcggtgcctatttaattcatgcggcgcagatggcggataaactgacgctgttttctaacatggtggtattctccagctatgcgatgcaggttgttatgtcgtttttgatgctggtcatgatttttattatgctcccgcgagccagcgtttccgccaggcgaatcaatgaagtgctggacaccgaacctacaatccttgatggaggcctgacaaatggagtacctggtctggaaggtgaggttacgtttaaacatgtgggctttaaatatccggatgcagcggattacgtgctggaggatgtgagctttacggtaaagaagggggaaacgattgctttcatcggttccacaggaagtggtaaatcaaccctgatcaaccttgtgcctcgcttttttgatgcgacagagggagaaatcctgattgacggtgtggatattaaggagtacacacaggaggcactgcacaataaaattggttatgtgccgcagaaagcggttctgtttaagggctcggtttcctccaatgtggcatacggagataatgggggcaatggcttttcagaagacgaaatcaaaagagctgttgcaattgcacagggtacggattttgttgaacgcatggaaggcagttatgaagcagacattgcccagggcggtaacaatgtatccggcgggcagaaacagcggcttgccattgcccgcgctgtctgtcgaaagccggaaatttatatatttgatgattccttttcagcactggattataagacggatcggattttgcgtaatgtgctgaaaaaggaaaccgcaggtgttaccagtatgattgtggcacagcgaatcggcacgattatggatgccgatcagattatcgtgctggacgaaggcagggttgtgggcaaaggcaaacacaaggatttgctgcagaactgtgaggtatacaggcaaattgccatgagccagttaagtgaggaggagcttgtgtcatgagtgaacaaagaacgaacagaaggccggtagccggaggtcctgtgggacagggggctgtcgaaaagccaaaagattttaaaagaacatggggaaaactgatcgcctattgtaaaaattatatgcctgcagtggttgccgctcttgttatggcagcaatcggaacagtgctgcaaattatcggtccggataaattgaaggaaatgaccaacgagatcatgaaaggattaccaacgatgatcaatggtgttccggtcgccggtgcaatcgattttggtgcggtaaaaagcattgggtttctgctggtagctttttatgcaggctcagcgctcctcaactttattcaaagctttatgatgacaacggtaacgcaaaaaatcagcagaaatatgcgtaccggtatatcacagaaaatcaataagctgcctttgaaatattttgaccgggtaagctatggcgatattctcagcagggtgaccaatgacgtggataccatcggccagaccatgaaccaaagcatcggaaatctggttacatccatcaccatgtttgtgggctcagcaattatgatgttctacaataactggattatggcgttgaccgctgtgggatcaagtgtttttggttttattatcatgggtgttatcatggcaaaatcgcagaaatatttcgttcagcagcaagaagatctgggtgtagccaatggtcatattgaagaagtttattccggccataatgtggtgaaggcttataacggggggaaagaggccggacgtttttttgaaaatgtgaacgagagcctgtatgacagcggctggaagagccagtttatgtctggattgatgatgccgcttatgacgtttatcggtaactttggatatgttgctgtctgtgtggtaggtgcggtgctggctatgaacggaaccatcagctttggtgtgatcgttgcgtttatgctgtatatccgtttgtttacccaaccgctttcacaaattgcacaggcattccagaacctgcaaagaaccgcggccgccagtgagcgcgtctttgagttctttgatgaagaggagctgtctgatgagagccaaaaagcaaaaacccttatcaacgtgaaaggtgatgtggaattccggcatgtaaagtttggttataccccggaaaaaaccattatcaatgatttttcagctcaaattaaagctggacagaaaatagccatagtgggtccgaccggtgcagggaaaacaacaatggtcaatctgctcatgcgcttttatgaactggatgggggagagatattgctggatggcattccaatcagccaggtgccaagagagaatgtccatgagcaattttgtatggtattgcaggatacatggctttttgaaggcaccatcaaggaaaacattatctacagcaagccgggggtgacagatgaacaggtgatcgctgcatgcaaggcagtaggacttcatcattttatcagaactctgcctcaagggtatgacacattgctgaatgacagggctaatctttcacagggacaaaagcagcttgtcaccattgccagagccatgatccaaaatgctcccatgctgattctggatgaagcaacaagttccgtagacacacgcaccgaaattctgattcaggaggctatggataagctgacgataggacgcacatcctttgtcatcgcacatcgcctgtccaccatcaaaaacgccgacttaatcctggtcatgaaagatggggacattatcgaaagcggcagtcataaggaactgctggaaaagggaggtttctacgcggagctttacaacagccagtttgaacctgcagcatagatctgtttagtttcttttgaaatttctttcattgatataaatctaaaaatacatgaaaacatcaaaaaattcgttccgccctctcacaaatccggcagtgagggggttttcttcatttctcttttatcattcagcatctgaatttttaagtgaaagtttactttcattttaccgcacattggtggataagtttacatagtacaattatactgaaggtgaaacaaaaatgattttaaagttgtgacgccgtttttagactgtatcaggtcattcggcaaaccataggataaggaggtggctttatgcagctgcaatttccggccttgccggaagaactgaccagcgcagaacaaaaaattgtagaatatatcagcagccataccgacgaatttttgtttaagcccatagggcagctgtctgcctgtctgggaatatcggatgccacactttcccgttttgcgcggcatgtgggatgtaaggattttaaggagcttaagcatgtagtcatgcagcaaagtacgggacatgggctgacacagaaaatggctgcagccttgatgcaggagaggggatttatattgcaaaactggctcttgcgacagcagttttgcttgcagaaaaccctggagcagctggaagtatcggaatttgagcgtgcaattagggcgattatggaggcaaaatgcatcttcatccacgcgaaaaatgcctcctcctcgctgggacagcttctgtttttccgcctgcgccgcctggggctttccgtgatgctcctcccctccggcagctccgaggggcttgagggtttggcacaggccgcagcaggagaccttgtcatcctgtttaacttatctaaagtttcccgggagggacgtatgattctcgattatcagaaagaagccgcttatcatacgctggcctttaccagcagactgtatgcacctgctgagcaaaaagcggatgtgcagctgtatatttaccagggcgaggaaagggaataccattccatgtcagcccctgctgctatcgtagatgggctggctgtggcaatgtccgaacgaatagggtttgaatctgccccgtggccgtaaggaggaaggtacatatgaatcctgcaagtatactgtctgagattctaaacggaggccacattcggtcggtttaccagcctattgtttccttccaggatggcctcatctggggctatgaggctctgagccgcataacgcttcctgactgctatttaaacatcgagcagcttttcgaactggcggtaaaaacccggaaactatgggaactggaaaaactctgccgtacccaggctctgaaaggtgcccgtaccaaacctgccgggatgagactttttctcaatgtggatcctaataccgtctatgacccaggatttatcgccggatttacccgtgaaaaacttttgaagttaaaactgaaccctgatgatatcatttttgaaattacggaaaagaatgccgtcagctcactctctgtttttacagaggcattaggccattaccagcagcagggctttcaaatcgccatcgatgattttggttccggttactccggccttgcccgtgcctgcgtcttttcccccaattacttaaaaattgacatgtccattgtccggggcatcgacagggacaggagaaaacgatccgttgttctgggaattgtgaagttctgccgggaagcagggattcagatcattgctgaagggatcgaaacccgggaggagctgtccgtcctcatcgatcttggtgtggattacgggcaggggtactttctggcccggcccgatgaggcgttcccaacccttcgcggagaggtggagcttctgattcgccggctttggaaggagaaacaggctccggccccattgcccttaggatttgatactgttggatccatctgccagcgaaaaccgccaatctccccaaaggagcatgcccttcctatctacgagcgtatgaaagcagacccctcgcttacggaactttgtgtggtggatggggaaggccgcattcacggcatccttacccgcagttatctgctggggagcttcagcggacagtttggatacacactttcttcccgccggactgtgggtgagctgctggggcaggactttatggctgtagactgctgtgcgactgtggacgaggtggcagccctggcaatggagcgggatttttccagtgtctatgatgctgtaatcgtggtaaaccatgggaggtatctgggtgtggtcactgtccgggatctgctgattgccgccatcagcatacgggaaagaaatgcggcagatgccagccccctcacaggtctgcccggcaacaatgccatccagcgcaccatctttgcgctgattcaggagacggaaccctatgccattgtttatctggatctggataactttaaggcctacaacgatgcctatggttttgcatacggggactgtatgctcaaggctctggctcagacaatgaagctctgctgttctgaggaagatttcatgggccatatcggcggggacgactttgtgattatcacccgggacatggagcgtttaccaaagctgtgcggtgatatcattgtcacctttgccggccagattgagtccctctattctccttccgactgggagaggggatacattgtttccaaggacaggaatggtttttcagataatttccccatttcgaccctgtctattgccgccgttaccaatcgtgaccataacttcaccgagaccgaagtcctttcccagaccattgcaaaaaccaaaaagcaatgcaagcagcaaaaaggcaacgcagtaatcattgtataaagcctgttacttaaagtgaaaaatacaacatatgcagaaagtaggagtgcaatgccaaaaacttatgtgctagataccaatgtgctgattcaggccccttacgccttagaatcctttgaagagaactacgttgtccttcccctggcggtgctggaagagcttgacaggctgaagaactccgacggagatcggggcagcaacgcccggcaggcgattcggttgctggaaaatctgcgcctttccggaagcctcaccgagggagttccccttcccggaggtggattcctgcgattggaggtaaaccatgtggatgttccgctgcccgaaggaatgcagccctgcagtcaggacaaccgcattctgaaagtgtgcaagggattgtgcaatcaaggggaatctgtcattttagttacccgggatattgtagtccggatcaaggcacagatgatggggattcctgcggaggactttactaccgatcaggttcccgctccttcgggccagtacactgggcgagcggaagtatatgctcccgatgaagccctgtcctcctttaagaaaaaaggagtgccggctgagctgctttacaccgtggatgatgacggaacaacggtcccggtaaaactcattgaaaatcagtttgtactgatccgctcggatatttcggaaaaaaagactgtactgggccgctttcataagggaaaagttgtcgcgttggcttacaagaatatccggccgttcggggtaaaagcacgtaacgtgggccagcagtttttgcaggaagccttgatgctccccgctgatgaggcccccttggtgattgtaaaaggccctgcgggtacggctaagacattttacgctctgggggtgggattggaaaaaacagtggagcagtcacagaaagaataccgcaagcttctcatctgccgtcccaatgctcaatttgatcaggacataggtttccttccgggaagtgagcaggaaaaaatttctccacttcttcgccctatcgtggataaccttgaaatacttctggatcacggtccccatgaatcccgctgggatgaaaaggaactgcacagcagaatcgattatctttttacgacaggtattatttcagccgaggcgatgaactttatgcggggacgttccatcactgatacctggcttatcattgacgaggcacaaaatctgactccgcggcaggtgaaaggaattgttacacgtgtgggcaagggcactaaagtcattttgctgggagatccggcccagatagaccatccgcttctggacgagcgcaccaacggcctttcttacgcagcagagcggatgaagggcagcccgctcagtgttcagcttaccatgctctctgatgaatgcgtgcgctcggacctggccttggatgctgctcagaggatgtaaaagccacgcagaaagaattgggaagccggctatgtccgctaagatcagaagccgcaggcgtaaaagcctgcggctgtttttcactcaacagagacggacagctggtaaaaattaaagacaaagaatctataaagaggcctttatttcttccgctgtatagctctttttacggctgccgcaatatcctgggccgtaagctcgaatgtatcgccagcaagacgtaaatctatctgctttggagcgaatcctagaaaaggcatttaacaatgaccggccatgggacgagttgttttgctaaaggggctgttgtaaaggtagactgaatcacctaccggagcagcagctccgtttttatgcttaaaagcgaaaaagcaggttttgaagaacctgccatccatggtataattaattatgcaaataaaaaatgattcaaagtaaaaatagtagagttgttcataatatgcaaaatgaatacaggaaaaataaaagcgtaatatttagaaaggtggttcctgattacgcattataaaaatattaattataaaaggagaacttctaagttgaaaaaaatcctcgtaattgacgatgagattgcaatcagagatctgattgaattggtgctgaagagagaaaattatcaggtgaaaactgctgaaaacggtgctattggacttatggagatcaactcttttcatccggatctggttttgctggacttaatgttaccagactattccggttatgatctttgcagggaaatagtaaaaaaatccacaatccccgtaatcatgttatctgcaaaaaatgaaacaattgataaagtgttgggccttgagcttggagcagaagattatttgacaaaaccttttgacaacagagaactcatagccagaatcaaagttgtattaagaagatatgaacccggtgaccagatcacaaacagcaatacgaatccggttatatgtggtgatctggagattgattttgaaacaaagagggtgataaacggaggaaatcaagtttctttgacagcaaaggaatttaaaatccttgaaactctttccaaaaggcctaaaaaaacatttaccagagatgaactcctggaaattatatgggggtacgattatataggtgaaagccggagtgttgatatgacaattatgcggctaagaaagaaactggaagacgattccgagaatccaagatatgtaaagaccatctatggattcggttaccagtttggaggtgatactgattgaagtatgcaaccaggcttctgttaagttttttatttttctctatattatccttttccattataattatctgggttaataaagccattgatcactatagctttgtgacaatagagaaacagatgatggaaaaggcagatatttgtgagctgtcttttagagagatactgacaaagtatgaaaaatcaactgatcaggaggaagcttcccatgtggcaaaggctgtactggaagtcttaaaggcttcaggaaaagaagtaagaatctatgataatcatctgaagcttttaggattggctgaagatggaattgtcgtgtatcattcctctcctaaaatttttatagataatattaaaaatgccttaaaaggaaattattcttacacagtcactaataagagtttgatttattttgcaatacctattcaagataaatattatcaaaatgcatatattttcgagatagtagaagatatatcttatttttacgatattatggataagattagatttgtattgataatcggtgcaggtgggtttatctttctcataactctttcaagcttttacattgcccgtaaaacaacaaagccgattaaatatcttcttggagcgacggaaaagttttccaggcagcaatttgatccggtcgaattaaaaagaaaagatgagcttgggatgcttgcagcaggattaaaccagatgggtattaaattaaacgactatatacagtatcaaaagcagtttatttccaatgtttctcacgagctgaagacaccccttgccgcaattcggggattttctcaatatttatacgagggagaaaatgaggataaagacttaaaaaagatatacttccatctggtaaatgaatcggaacgacttacaaagctcatcaatgagcttttgaccctttccaaatttgataatgcagcaccggagcttaacacggataaggaagatttagcggaattaacttatcatgttattgaggagatgaagccaaaagcggaaaagagagaaatatcaataaaagcagatttggtaaaaggagcttgggccaacgttaataaaatattgatgacacacgcaattgcaaatattctggataatgcaataaaatactctgataaaggaggacacatcagagtagagacttctattgatcaaaatacagcagttataaagataagtgatcagggcattggcattcataagagtgacctttcccttgtccaggaaagattttacagggctggaaattcgaattttgcaaatggttctgggctggggctatctctttgtaaagagatcgtagagaaatttaaaggccggttaataatagaaagtgagattggagtcgggactagtgtgtcacttttgcttccattagcataatgttacaagaatgatacaagtttgttattactctaataaaactttcatttataatcacactgagacagaaataaatagacttaaaatatttgaaggaggaataacaatgaaggtatttagaaaaatggctataatggccatatcttttgtattttgcggaatggttttaggagggtgtggtaaatcaccaggaaatgcattaacagatacgccaaccgacacaccaactaattccgctggcgaaacccaggctggtacatcggctgagactgtagaggacagttcaacggatggttccgaagaaataataaaagaaggcacggttgaaaagagcggaaatgttgttctaaaacagctggcatttgtgtacaaagagaataccattgccatttcagacattgcagatgatcagaaaattgagagtatgctgggaaaggcagatgagattaaatctcatacttattctgaggacgatggtttaaacatggatcagctgaacggattgacagaaaaacagtaccaatatcctggtcttgttataaaaaccattgatgcggccgaagataagaagtcatttatctttcgtattgaaatcactgacccccaatatcctacagtaagaaatatcaaagtcggagatagctttgaaaagcttaaagaggcttatcctgaagggaatttaatgggaggtgaattgagtgaccaagaggatgatttccggtatgaaccggttaattatgtggatgtgatgagctttcatataaaagataaaaaggttgaaagcatcctgatatattcacttatagattaatgggcaattcagaaagctgcaaggcaggggaaatttaaaatgcttctgtgacatctggaagattacatgaaaaacgacataataaagccaaagggcggtcttggataaaccaaggccgctgttctcttttaaagcattggtccggattgacatagtatcgttttttaataattgtccatggtattaaattattccccattgtatcaaaggctaaaattatgtataataacctggcagttagttttgcctaacaaaaagtaggaggcctgttttgaaaaaggtaaaattcagttccgtaaataataaaaagtcatttcctttcaggctggttgttgctcttttatgtgccgccctcattctgtcagtatttttggctcttgggcttggtgcggtacacatatcccttactgatacatatgccatcattatgaaccgcctgtttggtatagaaaggcagggaacaggtgaaattttaaagagcgccaatgcttccatcatatggaaaatccgctttcccagagttttgcttggtgttgccgcaggtgccggtcttgcactgtgtggatcagtcatgcaggcaacagtacaaaatcctctggcagagccgtatattctggggatatcttccggagcgtcgctgggagctacgattgcggtttttatcggtaccgcgattccgttcatcggcagcatatcttcggtatccctgctggcttttttgggagcagtgggagctaccggtgcggttttattcctggcctctgtgggcggacaggccacatcaggcaagctgattctttccggaactattattaatgccatatgcacctctttttcaaattttattatttcagtagccggcgatggaaacggtatgttaagcataaaattctggacaatgggatccctgacccggggaagctggaataaccttattttgcccagctgcgttgtggctgccagctgcatgttttttctcagccagtaccggactttaaataccatgctgctcggtgatgaggcggcatctaccttgggcgtaaatctcagcttttacagaaagctgtatatggcagcggcggctcttttaaccggcgtattggtctctgcctgtggtgtgatcggctttgtggggcttatgattccgcatattgcaagagctgtagtgggagcggaccatcgccgcctgctgcctgttacggttttgctgggcggaatatttctggtttgggcggatgcgctggcaagagttgtaatacccaatggggagcttgccattggaattgtaacatctatgattggcgcaccgttttttgcctatattttaataaaacggcattaccgttttggttagtgaggtttgagaatggatgttactgtacgggacttaaaagttcatttagcggcaaatgagattttaaaaggagtatccctggaggttaaaaatggaaaatttattggtgttttagggcctaacggcagtgggaaatccacgctgcttaaaacggtataccgtatgcaaaaggcatctgacggtgtggtaatgctggatgataagccattgcaaagctacaagccaaaagcattggcccgggaaatggcagtcgtagggcagttcaacaatataaattttgatttaacggttgaagaaattgttatgctggggcgttcccctcacctgggtgccttggaaagggagaagcagaaggaccgggatcttgtggcggattctttagcaaaggtaggtatggaaagctatgcaaaacgaagttttgccaccttgtcaggaggagaaaagcagcggattgttttggcgcgggcgctggcacagcagccgtcccttcttattttggacgagcccacaaatcacctggatattacatatcagctgcagattttaagtattatcaaaaatttaggtattaacgttttggcagcccttcatgatttatctttggcagcacaatattgcgatgccatttacattttgaacaaagggatgattgattcctatggatcacccaaagagattattgaccgcgaaatggtacgccggatttatggggtggattgtaagataacagaggacagtcaggcaggaatggcaatcagctattttccgcttgtgtaacatgacaaatttaacctcattaagcagcgaagcggattgcgaatatccgattgattaaaaaaggagtaagaaatgaaaaataacaggatgagaaagaacatggcggcttttacagcaggtactatgattttaggagcaattttaagcggatgcagtccaaagggggataactctcaggttactgctgccccacaaagtacgtcctccccttcgtcagaagtttcacaaagcggtagcgtgaataccgggtatccgattacggtagaaacaaaaggcagtgactttgtcaccatagggcagacatataacaaggctccggacagagttgttacagccaatgcatcatccatagaactgctttacaacttaggtctttcagacaagattgggggcacaatagccattgacaatgcaccgggagaggagtggaaagaactgtatgattcactggacattctgggtgataagatgaccatcagcaaagaggtaattgcggcagcccagccggatgttattatcggacgcagcgcaacgtttgcagagggtacctttggctccattccggaactaaatgagctggggatcaacgtttatgcacaaaaagcaagtgatatgagcacggatgtttccatgaagaatattattgatgacgtaactgccctgggtgaaatttttgatgttcaggataaagcaaatgcatatgccgaaaacctgacaaagcgtttcaacacagtttcagaaaaggttgcggcttcagctggagacaaaacgtttcgtgtgttggttatggcaacttataaggaaggaacatttgtggttttcggtgcaaatgcgaaactgcaaaatggaatgctttccgcattaaattgtgtaaatgtcatggataagggcggttccaatctaacattggaaaaccttgtagaagcaaatccagatgttattatttatattaccgcggaccgcaatgcggaaaatgatgcaaaggctgtagaaagtataaaaaatgaagaagtactggcatcaataccggctgtcgtaaataacaggatcattgaaataccctatgatgcttttatggactatggtgtgcgtaacttcgatacgttggaagaactttcagacttcctctataactaattaaggtggaacaaatggaaacaattcatgcagcagggagagacttggaactgttggtgccacccggcttttcttccggaacaagcagttgtccggttgtatatgcgctggatgcagacctcattttccaggcactggaaaaaattccggaagaaaagaaatcatacccctttcttttagtcggagtgccgcctttgaaccggctgtcccagtatacaccctggcctgccaaagcgcttcatgaacgctttgccgatttcggaggcaagggagaggaatatctggattatttggagaaggttctcattccaagcgttaataaggaactgtttggcaatgtacctcctgccaagacagcattattgggacactcccttggcgggctgtttgggatatatactttgtataagacagatgtttttgatcatgttgtttcaatttcgggttccttctggtatccggaatgggctgagtttgtgaaaaaaaatgctccggtcaacaaaaacgtgtccgtatttctttcttcaggagaagatgaagggaaagatgcccatgatattaaaagaaatgctgcacaggcaacaaaagagacttatgaagcactcctgaatcatttgccccagggcaatatagaaatgcagtggaattcttatggtcatcatgaaaatatacctctgaaattatccggggcactggcttacttggatgagaggttcccataacaagcataaacacatacgaattaaaacctatttgggaaaacaccgcaaaggaacagtctgtccttatgcggtggtttccctattaccatatggaaagaaaggatggatcaaatggaggctcaaactgctctgaatatactgaaacaggcttatcggctttccccgttccgtgtgaataatgtaataaagtttgtgaaatacccatcggacaagcctacctcttaccaaaccatacacggagcatttatctttccccttgagggagaagcagagataaggttcgatgataaatgctttaatgcaaagccagggacaatggtgcatggctgccctgggtgtcagcttacttttcacgttttaggggataatccgtttactcatatcaatatttattaccatcagataagcagtaatttattgtttttcatgcccattgatttgcctgctgttttaccggttttgcaagaactggccgatgccaatgaacagatagatattcattccattcttcaaaagcaattgctgtcccgccaggtttttcagaacattttcttcaacggtgagaaggataatgctgccgaagattaccatattgtgaaagagcttgtggactatatagaagataactacaggaatgcactgacaatggaggatttggcaaattatatcgggaaaagcaaatcacagctttcctatcttttttataaatacacacaatgccggcccattgattttctcatagattacaggattaatgtggctgctaagcttctgcgggagcaggggtgtactgtgacccaggctgcggatgctgtggggtatgcggatccgcttcatttcagccgtttattcaaaaaacgcaccggctatgcgccgagccagatacaaagaaaaaatggagaataagtacattatggtaatgtatcaatatatgccggatttatctattacatcagcatcatatgaacctcatgtaagggatcccaggggcaatagctcatagttttctgattttactatgaatattttttggtggttttaggtttgattatattttttgtaacaataacatgggctttttgggcaaaggcccataagccatataagtcttgaaatttgatttcgattaatgttcaggctttgctgaaccaatacgttcgctatacgtaaagaatcatatctatctatacgttcttaaaaactcgtttgatctcttggctaagcatttgattttcaacgtctcttttccattacttatgatttaagaatttatattaaccagttcttgatgcatttaaagttttgaaagccttcttgatgtttaaagaattttgatgttctttgttataacaaaatcttatgtattcttctttagaaggcccggaatttgttaatagttcaagctatttacgaagtttcaggttttcttgtgctcgtttttgatttcatactgatacaaataaagcgcggttccacgttctggaacgcactttattcgtattcttcaggttcacttatccaacgatataaagaactataatgaatgaaaagttcctttggcatttctgaaacagacataccatctttatgaaaaagttttactgcaacaattttaaatactttatcaaagttccttcttgctatagcgcagactacctttcacaatattcccttgactatgtgtttattttattacaccatatctacaacaccctcttttaatatgtccttaacaaagggtgcagtttgcttgttatgatacgcttacttccgatcagtacaccgattggactcaattttaaacactgctttcatactaattcgttttctgacaaacttgtcactcaatacatattatagggtataaagaattcaaagtttctttatatattctgttttaaatcctgtacagaatacttatatgcaaagaattaaaacaccacaccttaacaggaggggattataatgagtaattgtagaaattgtaacgataatttccgctgtgatagtcgtagttgttgcgctggtcgcagttgttgtgagggttccggaagctgcctaggaccaactggcccaactggaccgactgggccgcagggaccaacagggccaactggtcctggacctattggagcaactggccccaccggcccgactggtcccattggtcttaccggagcaactggccccataggacttaccggtgacactggtccaaccggtcccactggcccaacaggcttaacaggccctatagggcttactggcgaccctggtccaattggccccactggccccatcggacttactggcgaccctggtccaaccggtcctattggacttactggagatactggcccaattgggcccaccggacctactggagatactggcccaattgggcccaccggatctactggagatactggcccaaccggtcccaccggacctactggcgttactggtcccaccggacctatcggtgacactggcccaacaggccccatagggcttactggagatactggccccaccggacctactggagatacaggacctactggccctatcggacttactggagaaactgggcctactggacctacaggcccaaccggccccagcggactaactggagatacaggacctactggacctatcggagatattggcccaactgggccaaccggacctattggcgatactgggccaactggccccatcggacttactggagacactggacctatcggagatactggcccaactgggccaaccggacctgccggagacactgggccaaccggtcccatcggacttactggagatactggcccaaccggtcccatcggacttactggagatactggcccaactgggccaaccggacctactggagatactgggccaactggccctattgggctaactggagacactggcccaactgggccaaccggacctaccggtgacaccggcctaacgggagcagatggagtgaccggtccgacaggcccaccgggtcaacctgcccaactgtcaggtattcaagtgcaatatatcattacctcgacggaaacgattaatgacggcgacctcattccgtttaaccagttaattgacagcaatggcacttatattaatttcaatgctagtacaggagagctcatattgcaacaaccgggtagctattacgttaattggtgggcagcggtaggcggttcccctatagcaatcacattctcacttgctttacaggtaaacggggtggttcactcaaactcttcttcgatcattaacagtgagcaaatatccggttcagattttcttagcatcacaaccacgccggctgtcattacactcaacaacgtgacgggcaacgaaattttctttttcgaacttcttgcaaccgcaaatctgagcattatttatcttgaagtgtaattttagatagtttcatcattttggcattcctggggccttctgttcttaatgagagctgaaggccctaatgccattatcctgaacgtcttcctccgtagtccgcattccattatcattttttacttggaacggccagtctttgaagggtcaagctcggaaaagtctagaaaaaggcttggtttttaggtcaagtcccataaggattcacagtcccttctttatacatcgggcccaacatggcccgatgttctgctgttcagatacagaaataccgctctgcttgtccaatagggctgtatactgtgtaaaggtggcggaacatgttttattttgagagtttctattcgggacatagaataaagcgtttcccattttccttatatgtgcgcccctaccggccccgccgggcttgctggtgacaccggccccatcgggctgactctgattacgcaagcatatgcaaatgcaaatataccagagcagacggtagctacaaatgctgctgtcacgtatgggaccaatactacagttggaacattagcggctggggacaccgtacaggttgtaaacggagctgttgagactgtgacactggcggaaagccctggtgttaccggcagtgccggacacctgatgtttttcaggatcgcggatatgggaggataattttaacggcaagagcaggcgggaattggcattcgtcaattcccgcctgtctaatgcgattttgtctgaggcatatacagaaaagcacttccattctctggactttatgttttcgacttctatgtaaagcagtagcgctgcattcattatacaagtaagggatgtacctccgttgttccgtaatcacagctgaaatacctctgccggaattattatatggaatgcattctgaaaaaatattcatgactcttagcttattaatattgatcaaatggtgcagttgttaaggtgacctttcagcaccaatatatattttttatatttcggacaaggaggagaggatatttccccaatattaatatagtggtaggtttacatcagttcaattgcgggcaaagatttttgtttgaataaataatataatacttgacaaaaagaataaggcaatctattctataattgaacgttgttcaattacaaaaggggaataattatgactcatcgcaggacaatgaaaagtttacggctaatgagttgctccaatggaatttgaaaaagtgcagtgaattcgctgctgattgctttcgggcatttagggaatataactgacttggtcattattgaaaaaaccgaaggtgcgattgcgggtacaagaaccctctgcacttacggaaaatccaaattctaaggaaacagaaaaatggctattatttttgaggtaaaagctgtgataggagaatcttaatgaaatcggagaaaaccaaagaaagaatcgtagagcaaaccatagagctgattcaggaatccaatggtctgacagaaaacatcaccatccggaaaattgctgaaaaatcaaatgtaggtttaggactgatcaatcactattttggtacaaaggaaaagttgattgaggaatgtgtgcagggaatcatcagcggggtgattggtgcttttcgcccaaactatacggaagaagaggactgtgttgcagccaccaagcgggttgccaaacaggtgatggattttttaatggataatccggaaatatcaaaagtctctattttgggggatttaaagcagcctgaggaaagggataacaccatgggtactgtttacggttttggcagccggctgtccggcgggaatatgcaaaactttcataagatcaattcatttatgattactgctgtcatgcaggtagcatttttgcgtaaggatatcctgcgcctgacactggggattgatcttaatgacaaggtacagcgggatgtttttattgatgatttaattgagaagtttcaataacacgttcaccatcgcggggagcccgccccaaacgaggaaaaattacaattattcaggaggtgatatcttggggaagaaaataattattgtaacgatcctgctagctatcatggctggcgtaggttttctggcagactatcttctttcggttcaaagatacaaagatatgattgccaatattacttatgttaatgtcaatgcctccgatgtgccggatggtacgtatattggcgattatgatgccggatttatttctgcaaaagtagaggttgctgtagaaaatggcatgattaccaacataaccttgttagagcatcacaatgaaagaggcaaatctgcggagggcattgtaaacgagatcgtggccaaacaaaagattgatgtggatgcagtttccggggccaccaattcaagcattgtgattaaaaaggcggttgacaatgctctgtctaacgttaattcgtatccggcactggattaaggtatatcaagagttgaattaaatttaaaacggtacatatggttgatgcatgcaattaaaaaggtaaggatataaaaattgaagtctggtgcaggttgattatgaataaaccctgctttcccattgggaagagctggaagaaatggtgaatggtatggggagtaatattgaaaaattatcaaaaagcagacatcagttaaaaacagtggtaatgttaggatcctttgcttttggtttaatgtcatttgtattgccgatttatagtaaaaaaattggtggagatgcattatctattggagggctgttttcaatattcagccttgtaactttgctgttaaggccagtgatcgggaaaggtactgataaatacggcagaaaagtttttttcgttgcagcgtttttcttttatgggctgtccatgttgttgttctcatattcaaccaatattctcatgttgtatatgagccggtttgtccaggcaataggtgcttcgttcatgtggatttcagcatattccattgctatagataccgcagaggatgaaaaaaaaggagcggctattgggcaagttgatggtgcaagcagtaagggatcgttttatggtgccttgataggctttacattaatgggcaatttcactcttatgagcggttggagtattttatttaagggatatgcagtattgtccattgcagcaggctatatagcatacaggcatataccggagacaaaatccttcggacatgaaccggctgattgcggcagcagtgaatggaaccatggatttgtaaaattattattagtagtatttttcagtgcaatatcaatatccatggtgagccctctgctgatgatttatcttcaggagaagtttaccactgatgtgggtgaattggcggccgcttttgtgcccgcagctgtagtatatgggtttttacctggaaagctgggcaaggtcagtgataaatttggcaggatcatgcccttggttataggactgattgcttcaggtatagtttctttatgtttccccggtgttcacagtatgaaattattggttgtactttgggtcctggagtccataggggttgtcctggcttctcctgcagagaaagcattggtcgcagatatggcgggagaaaatatccgcggttcggcatatggcatgtatttgtttgcagctagtctgggcgcagtcattgggccgttgatgggcggatggctgtatgacactttcggatatgggtttccgttctatgtcaatgggattacgctgttgcttgatgcaattttagcaataattctgttgggtcaatacagaaaaaatgtgccgaataaaaattaaatgttttttattccgctatttagatatagcattgaataaacagttacaagtattcaatgctatattttttcttttttatttgctataattaatcaaatcagaattttaaaatgagaggagtaagacaatgattgttagaaaagccagttcagataagataaatgacatcataatcttttatgataagatgtgtaagatgcttggtaattcctcttttttacctgaaggaaataaaggaggatttccctccggaagattaatagcagattctattaataatgatgaattatttgtcggaattgaagatgattgcattatggctgcatatatcataaatcatctttgtgatgcttcttatgataacgtaaaatggcaggttgatgccaataaagaagaagcctctattctccatgcacttcgaatttctccggactatagtgggcgtggttatgcaaagagattagttgaacacgcaatccagacagcaaaacagaataaacaaaaggctattcgcctggactgtattaaagggaatgatgtgccgcaaaaaatgtacctgtcatatgggttcaagcatatcgatactgtagatattttttatgaggacattgggatagaaaggaagtttctattatttgaacttttgctgtaaataagaatcaggtatacagtagtaaaatgccgtttacatatcaatttcccagtagaagactgtgaggtgagaacctaatatgacactgcaaataaaacgaatctatgaatcttttcaggaaagtgatgggatccgtttgctggtggaccgcctgtggccgcgggggatttccaaggaaagggcacacttggacggctgggtgaaagaactggctcccagccaacagctacggatatggtttggacataaaaaggaaaacttcggcaaatttgccatgctttaccgcactgagctggatacagatgctgaggcacaagcagctgcccggcaggtcatccatcaaagtaaggaaaatatggttaccttgttgtatggggcaaaagaccctcagataaaccatgctgttattttaaaagaatatctggaatctaaaatagatatggaataataaagtcaatatatggttaaaagaatctggggtaagatggtctgctttatggaaaaaagcagccttgataaatcgaataggaagaatacggagaaagtgcgtttccatacatggaaccgcacttttttcgcatcaatatgattcttctctcttatgaattggatggaatattcacccattgctgcttctggttgctttcaaagattttactgcacaacaccatttcatggagtccatcctcaaaggtggcatactcacggatgactttaggattgtcaatgctgttatacacattggcaaaacactgcttaaaggcgtcgggaaagccctccagatgaccgaaaggataagcaatcagaggcctggtattgggatgaaccgttgctatgcctttttccatcacctggttgcagctgtcccgctggccgatggtcagctgattgcagacttcactgttccactccgcagatttcttgtagccgcctaccaataagtcgattgccacggatttgcctgcgattacctgggagaagaaggcgcttccctttgcgccgttgctgaaccggaacataacactggcattgtcttctgtatcaatggcaatgtcctcataatcttcctctgcgaatttttcctttgaaaaggcaattacatgtccctttggttttttgcgggtcggatgaatcgttgaaaaatctgcattcactgcaacgattttctgacctgtcacatattcggccagatccatccaatgagagccgatgtcggcaacagcgcgtgtgctgccggattcggaagaattcagacgccagctgtaatcagtctcgtacaatagccagtcctgggtatagcttccggtaatagagaaaatttcccctaattcaccatcctgaattacattttttaaatggttgttcatgggatagaagcggttatgaaaattaatggccgcgattaatccggtttccctggcttttgctgtcagtgcctgggcttcttctatggatacgcacatgggcttttcgcagataatgtgaactccgtggttcatggcgtacattgcgatttcaaaatgagtattattgggagtgcagatatgtaacacatccagtttcatggtatcgatcatctgcttatagtcggtaaaatactgcggaacattcagagactcagccgcttcttttgcactgattgtatcggcaagagccacgacttcaacgtttccaagacgcctaacggtttcaatgtggacccgtccgataaagccggttccaacaactcccattctgtaaattttcatattccattccttctttccttattgggttgtgatttgtatggataaaaagccatcataataatccttccatagagcgggatcctgaggctgatattcacggcagggaaatgcctcctttaccagggcccgtccttcttccacagaccggatctgtccgtcagccatgagctgcatcataatattgcctatggcagtggcctctgcaggaccggcatatacggggaggccgcaggcatttgcagtgaattggcacatcagcttgctttgagcgccgccgcctacaatatgaatgccggtaaatgtttttcccgtatgcttttccagcagctttaaattccatcggtatttgcaggccagactttcgtagacacaccgcaccatttctcctacagaaaggtgtacatccccataccgtttccggcaattgttccggatcttctccggcatattttccggagagaaaaaaccttcctcatccacatcaatgacatattgaaagggggaagccaaagcggccatttcctccagctgtgaataggaataatccgttccccgttcccggtaataggctcttatctgctgaatgatccaggttcccatgacattgcgcaggatccggtgatggccatggtaactgccttcatttgcaatattgtattgaaagccatactcattgatgatgggaagctctgtctcggtaccgatcagggcccaggtcccgcagctgatcatggcatggtcctggccggcctgggcagccagaaaggcggaggcagtatcgtgttcacatacggcggcgatctgaaagcctttggtgtttagctgggcattgaattcttccgtagtttttcctatcatagttccgggataggaaatatccgcaaaaatatgagaagggatctggtaacggtctaagatgaccggactccaggtctttagatcatagtcatacagctgactgacggaagccagtgtgtattcggtctgctgccggccggagagaaaatatatcagaagatcgggtatgaaaagtaatttgttcccctcttgataataataggtctgtttttcaaaatacatggaggccagctgcatcagtgtattaaaactggcattctggttaccgttgacacggtacagctctgagggagacatgatgccgtatatttctccggcatgcttaatcgtccggtcatcccggtagcagtgaacctgagaaagcagttctcctgccggtgaaacaaaggcatagtcgttgcagaaactgtcgatgccaagtgaccgtatgttatccccggtaatgtttaccgcaatgcgcaggccatgaaccagctcccggtagatttccaggatgttccagtacaggccgccggagagtgataccgggccatgtccgaactggtgcagggtccgaatggacaggcggtgattctcgtaggtgccaagtactattttgccgccgctaccgcctaaatcaaatgcaacgtaattcataaggttcctcctggtgaagattgttattttgctgcaagaacctccacattggaatattttaaataagccagctgggccagatccgttttgctgtccgtaattatataatcaatttcggctaggtccattagatatacctggccaacctgattgaatttggtgtagtcggctaacaggtatttggtctgggaatggagaagcagagccttttttatatcgatttcgtggatcccggaatcggttatatggttgctgctgttaattcccgtgcacgagaaaaatgctttgtttggataatagtgtgcagcgttttcaattgcaatattcccataaatggacaggtttgagtttttgaaaattccgcccaggcatacaacggtatgatttgggttttggtttttggagcattcaagcagaaaagatatggaatttgttataaaggtgacctggatatccggaggtatgtatttgtacagagataagcaggtagagctgttatcaatgaaaatggtatctccgtcctgaatgaccgaagcagccgctttgcagatcagccgtttttcctccacattctgaatgttccggacctgtatgggtgattcatagttcttcctgtgatcaggggacaatgcccactgtaagacagcgccgccgtgagtgcgcttcaaagcgccggattcttccagctcgcacaagtctcttcgtatggtttccctggagatatggaagaattgggctaattccgctacggtaacactgccattgctctttagccgatacataatttccgattgacgttccaaattgtacataccgttaaccctttgctgttagtataaagctttattcctttccgatcaagctgctggtgatggaacagaacgcatcgcattcaatccgctccagcatactgtaagctaaataaatattcggaccggatacaaccacgccatgaaggggcaggatcacgccgatgggctttttcatggccagttcccggtgatcttcaaaatactggtaaacattcatggaaagctcaggagtataagctttggtgtactcaatacagcccacatagcctctgcccatggtagcttccgttaaattggggataggagcggattttgccacaaacggcatacagtaaaagggatgggcatgtatggtgcatccgatctccttgaaattttttaaaataagggcatgcatcaggccttcccttgaaagctttcccgtaccttccaggatgttctcctcgtagtcgatcaaaaggaaatcctcgggttttaattcacagtgtttctgctccgacatcagggacggactgattaaaatcctgttttcatctgcacgcacggcaaaattaccgcctgcggcgttggttaaccggcgttcccacattaatttagcaaccttgcacatctcttcacgcaattcgatataggataaattactcaatgttaacactccttttcttatttataatgtaattttcgttatctgtacctgtgattccaattcccttgcccggtttaaatcaaagccaaccgaggacgaggattccgctgtggcggcagaaattgccgtggccagacgtaatgtattggaaaatgaataattttgcttcaagccatagataattccagacaggaagcaatctccgcagcctatggtatttttaaccgcgatcttaggcggctgtacccggtaaattccttccggtgtttttacaatggagccgtttccgcctaaagagaccgctataacgggaatgcggtacttttccagggattgaatggcatggattattttttcatccgtatccagtgtttcattgcaaaggctggacagttcatccagattgggcttgattaaatagggggattcctgaatgcactgtcttaaagtctctccgctggtatccagaaagacctttaagtctttgtccttcagcctccggattatggtgttgtatatggcagaatccggacaattggttgcgtcaccggacagaacaagatagtctccatcgttaatctgactgatcatgttttggatcagctggtcaagctccatctgtttcagcaatacgcctctggaagctaaggttgagcagtggccgttctcttctataattaaatagttggtccggctgtctgtatcagcggtctcatccataataaaattagtaaggattctgtgctcattcaataaatgaatgattttttttcctgtgggaccatgggcgattccaaaagcagcactgtccagaccgagaagtttcagattaatcgaaacatgagttcctttgccgccaatggtgtcatcggaatactgcagccggttggttatgtccttttggaaatgttctaaatacagaagcttgtctatggcaggatttaaagttacggtatgtatcatttcttaggtatactcctttccctgatgtatttttgctggagtgtgcgtttttgaccgtaatatttgcgtatacgattaaaaaataaagaaatcatttaactccaaccacatagtaacacgaaacgggcacaaacgcaacattaattttgattatcttttaaaacacacaaaaacggttatcgtaatttgtgcaaatatgacaaaaaagaatgatattgaaaatttttattgaaataaacgtaaatacatgatatattacacacataaacaaaaacaaacgcacaaatgcaaataggaggacgatatggattacaaaaaaacattactagaaccaattaaaataggagaccggatagcacctaaccgtttttttattcaggcaatggaatgtaattcggaagatgaaacgggcaatccctcggaggagacaacagaaagatactgtaatctggcaagaggagaggcaggacttatttccctggaagcgattacggtgaccagagaaagccgcgccagagataatcagctgacgattttgcctaagaatgagaaaccattgaccgcttttgtggaaaaggtccatgcagccaatccggaatccctgtttatatttcagctgacacattcaggggaaatatccaatccggcattttccaaacgggtgacgcccaatcctcttccgggatatggcggagagctgctgacggaagaagatgttgaaaggatcatggacagctttgtgactgcggcaaagattgcttataacgccggagcggatggcattgatatgaagttatcccatggatacttgggatgccagatgattcgtccccacaatagcagggactggaagtacggcggaagctgggagaaccggagccggtttgcttttgaattaattgagaggatacgaaaagaaataccggaccagaagttcctggtgggctcaaaaatatcagcctgggaaggctttccgggaggctttggtacagatggccccggttcgcctatcatggacttaacagaaccgctggctctgatcaagggcctggaagagagaggggctaactttattattcagtctgcaggcagcccgtccattaccatcagcctgacccaggtggacagacatattccatactatgcttatctgcaccagtattgggcaaaggaatttcgaaaggtgctcaaaccggaaaccgtagtcataggctccaatttctctccttatcgaaatggaaagaatgacttgtgtgcggtaacaccggaggagagcaatcttcttaattatggcgcatggtgtgttgaaaatcatgtgaccgatatgatcggtttgggaagacagtcatttgccgatccgtttttaccgaaaaagctcagggaaggaaaagaagaggaaatcaagttctgtctcctctgtgacaaatgtctggagctgctgatccagcagagcaaagtaggatgctgtgcgtatgataaggctgcccatgaggaactggtcagaacgcgcaaggagaaaggtaacttaaggattcatcatacctaagtggtgatcaaataaaatttaacttattggaggaggaacaatggtaaaaaaactaggagtgcttttcatgacagtggtcctgctgggaagtatggttgctggatgcggacaaaacacatcgaaaagcggaggcaatgatggaaaagagagctcaagcgcagcagtaaccagtaaagaggatcagacttcagcaagtgcagaggagaaatctgccggcctgatcggtattgcccttcccgcggccgaccacggctgggttgcaggaactatttactatgcggaacagaaatgtaagagtctggggcttgatgagggaagcggctataaaatagtaacttccgccaatgtaaatgaacaggccaatcagattgatgaattgattgctcagaaatgctctgcaattgttctgctgccccataatgatgaagtatccgtagcggcacaaaaaatcattgatgcaggaatcaagctgatcgtatttgaccgtaaggttacaggcgattataccgcttatgttgccggaaataatgccggcatcggtacgaatgcagcaaaatacctgggtgaaaaactgggcggaaaggggattgttgcggtcatgtcagctcccagcgttggctctgtcagcgtagaacggaccgaggcctttaaaaaggaaataacggcatcctatccggatgtccagatgattgaagtttctgcttccggatttactcaggaagccggtttgtccatggctacggacatgctggtggcaaatcctcagatcgatgcggtattctctattgatgatgagccttctctggggattctccaggcagtcaaggatgccggccggaccgatgtgaagtacatatccgggggaggcggagctcagtcctggtattctaagattcagaaggaaaccgatatcaactgctttactgagacctacagtccttccatgatcagcgatgcaattcaggcggcaaaggatattctggatgggaaatacgtaccaaaggataccatcattgaaccgtccactgttgatttaagcaatgttgcagattttgtgaattcagattccccatattgatgaaagaataagggtgcaaaaaaagcaggctgttgtatttccggtgagatatacgacagccctgctttcaacaggagtgagtattatgagcgaatacataatcaaaatgtgcggtattgaaaaaacgtttggagcaaactgtgtgctgcatcatgtggatttttctttgaaaaaaggcagcattcatgccttgcttggagaaaacggaaccggaaagacgacgttaatgaatatactgggcggggtaattccgggagatgcaggggaaattgcaattgatggagctgtcaataaaatcggagaccgaatgcatgggaatctgaatgagattgcatttattcatcaggaactgactctgatcaatgatttaaatatttatgaaaatctgtttttgggccgtgaactgaaaaagggcggccggttggacaaaaaaagtatgtatgaccaggcggcggaaatcctgggcagaatgaagatcgatctggatccggctgcaagagtggaggatatcaatgcctcatataagcagattgtagaaatagcaagggcattgatgaaaaattcgaaagttatcattatggatgaacctaccacatcactgaccaatgtggaaattgcccatgtgtttagtatcatgaaggaattgaaatcacagggaatcagtttcgtatttatttcccataaattaaatgaagtaatggaaatctgtgatgcgtatacggtaatgagggatggctgtgtggtcagcagcggagctgttggacctgatatttcggaacagctcctggcaaagtatatggttggtaaagaactgtcctataatgatttatatatggaaagaacaatcggcccggacatcctgagggtagaaaatttatccagagcctcagaattttcaaatattaattttcatgtgggccagggagaaattgttggatttacgggactgctgggagacggcagatacgaggtctttaatactgtctatggctgtaataagcagtatacagggaatatttttataagggattccaaatataagatggacagcacagtaaaagccaaaaagctgaagatttcttatttgccaagaaacagaaaagagaacggcattattaaggatttaagcattgcccataatctgtccatatccattataaaaaggctgcagaagcgtttctttattgaaaagaagaaagagaaacaattcaatcaggattatgtggagaaattaaatatcaagctgaatcatttaaatgatctgatcgtgagcctttccgggggaaatcagcagaaggttattctggccagggcgctgagctccaatccggatctggttatcctggataatccaacccagggcgtggatatcggagcaaagctggagatatacggtattatcatgcagcttgcaaaagaaggaatgagctttgttgttctttccagcgaggcccaggaagtgctcatgctgtgtgaccggatttatgttatgtatcacggggaaatacgaaaggaattccctcgggcagaagcaaatgaggagaatattatgattgttgccacaggcggcaagctatgaggaagatggaaaggtggtatacaatgaaaggaactggttcatcaagagactggaaaaagacagccagcgataacagcgctctgattgcatttgttgtactgtttcttttggcggtggcattgaaagggacaatgtttctgtcctggaacaacattattaatattttaagaaacaactcgattattggtattatcgctctgggcatgactctgatcattattaccggaggaattgatttatccgtgggatcccagcttgccatgatcgggtttgtggcaattaaggtgcttaatacgacacagagcattgtgctgaccatactggtatctgtggcaaccgcaattgttttcggctttttaaccggagttctggtggcaaagttcagaattcccgcctttatcactacccttggaacgatgaccatgtaccggtccatatcccagtatttcctcaatggtggaggcgtaatggccagcggagaaaaaatggatgcctacataaaaatatccaataccaatttattcggcaaaatcccgatgccaatcatatactgggtgatctgtgtggtcatcatccatctgctggtcaaccataccggaataggaagacatatttacgcagtgggaagcaatgaaaaagctacgttgttgtcgggagtatgtgtcagcaaggtgaagtattttgtgtacacagtatctgcagttttagttgccgttgccaccatagtggaaacctccagactggggagcattaattcctcgtcttccggctccagctatgaaatggatgccatcgctgcggccgtcatcggcggaaccagcatgtccggcggcaagggaaagatcctgtttaccgtttttggcacactgaccctggggattattaataatatgatgaatctgctgggtgtaaacgcatttttagtcggtgcggtaaaaggtgggatcatcattgttgcagtccttttacagaccagattaaataaagaataagggcggaaaatggaattataccgtgatcagttccacgccatagttggcgagatagctgcagctgcttctgtctgcctgactgtcggtgatgatatagtctatattgttgaaagaggataaaaagatctgtccgtctttctcgaatttgctgtggtctgccaatacaaacacctggttggacaattcgatcatcagcttctttgtttccagctcctggatgctggaatcggtgatcatacggttggcagagattccggagcaggaaagaaacgctttattgggataatataccttggcattatccagtgacatgttgccgtaaatggataagttggagcttttgaatatgcctcccaggcatatgtacatatggttctggttattcaatttagcggcttccagtaagaactgtatggaattagtaataaatgtcaccggtatattggcgggaacatactgggccagataggccgttgtagaactattgtccacaaaaatggtatcctccggctggatataggaggccgccagcttgcagatggcctgcttttcctgaaaccggcgtattccccggacggatacaggatacttgtcctgcatgacggcactgtttgttttctgttccgcgggcatggcgccgccatgggtccggatcaggactccttcccgctccagatcccggagatcccggcggatggtttcctttgatgtctgaaactgtgcggctaattcggcaacattcacatttttgtgtgtttccaacaaatttatgatttctgattttcgttctatattatacatggcgcctccggattcttaatataaaaatacttgattaagctcataatatcaattgttccggggatagtcaatacatattgtgataataaaagttgatttataacagaaaaaattatacaataacagaaacaaacgggcataaaaagaggaagtaaacaaagaacgaagaaatgacaatattgaggaggtagcaagatgaaactgggatttttttctgctaattttagtgagaagccgttggaggaggtagtgaagctggtatcagcctatggttatgaaactctggagatccctgcctacgagggcaatgggcaactggagacaaaggacgttataaagggcaatgccgcttccgatgtccggaaaatggttgaaagctatggaatgtccatacaggcattaagcaatcatgccgattcctttctgattatgggacctgccggcaaggaaacggattttatttacaaggggaccccggaagagaagatcaagcatgggactgaaagtctgatacgcacggcccaggctgccaatgccctggaggtgcccattgtggtcggatatccgggagtggaaaactggggaagatttttcttttttccctatggagagggctggaaagaatacgaagaacagtttgcggagcgttttacgccgattctggacaagtttcaggaatatggagtgaaatttgccattgagattcatccaaacagctttgtatatgatatttacacagccgaaaaggcgttggagctggtaaattatcatccggcgctgggatataattttgatccggccaatattatgtatctgatgatcgatccggccattgtaatcgaccggctgaaagacaggatttatcatgtgcatgcaaaggatgcggagctggcctcccataaccttcccacaggaggaactctgatgcatggagatatgtcggcattaaaccatacctaccggttccggattcccggctggggacaggtggagtggaagcgggtcattacagagctttccatggtgggctacaacggttccttaagctatgagcatgaggatgttaccatgagcagaatggatggagtggaaaaagtggctcagtatttaaaacccctcatgatcaagaatccttatgagggaagaacggacaaattatttaacaaagaatagaggagcagattctccattacagccaatgtcaggccgtcctgacattggcttattttttcagacccaattatagcaaaacaagcttatttcctagcaattaggaaacagatttacttccaaactctctttgtacggattatagttaatatcaaagaaccattcggtacgaaagtaccggccggttaaataataagagaggggttatacatatggcgagattgggtatttccgtttatccggagcattctactgaagaaaaggacatggaatatatcagaaaggcagggagattgggttataagagaatctttacctgcttcttaagcgttgaggggaagaacagggaagaggtaatgggccgtttccgaagactggcggatgaagcccatgcctgcggtatggagatcatacccgatgtgagccctgccgtattctcaaggctgggaatctcctatgaggacttatccatatttcaggaaatgcatgtggatggcatccgtctggacgaaggctttgacggcatgaaggaaagccttatgacttacaatcctcatggacttaaagtggaacttaatgccagcaccaagctggcgtatgtggaaaatattatggaccaccatccggaccgtgacaagctggtcacctgccacaacttttatccgcagaaatatacaggattgagcctgaagcattttaatgcctgtaatgataagatgaaatcactggggcttaaggtggcggcatttgtttcctgcaatgcaccaggagcatacggcccgtggcccgtaaacgaggggctgtgtactctggagatgcaccgtggattgccggtcgattttcaggtgcgccatctctttgccaccggctcggtagatgatgtgctcattgccaatgcctatgccactgatgaggaactgaacgcttgcgcagccctcaatcccagcctcctgacctttggcattcagagggagaaagaactgactcagaccgagagccagatcctggattatgagcttaagcatgtggtaagaggtgatatgggcgagtatatgatccgttcctccggacccagggttacatttgcggaccggtctatccctgctgctaataccagggacttaaagcgcggcgatgtggttattttaaatgagggttatcccaaatataagggggaactccaggtcgttaccaaggacatgccaaatgacggccgcaaaaatgtgatcggtcatcttcctgaacatgagcatgttttgctggattatgcaaaaccatggacagtgttcacattccgcaccctttgaacaggtgtacttacagaagaatgaagaaaaggggtatttaaacatgcagaataagagacaggagcagctgcttgccatattatctgagcggggagactggttaaccagccggagcctggccggtcttctgcaggtgtcggaccggaccatacgttccgatgtggaatccatcaacagacacatgatcccgcctcccatagagtccaatgtgcggcagggctaccgcatctgtgaaaaggccaggctatcgccccttccatctaaggaatcccgtgaagcggggatcccccagactcccggtgcccgctgtgcatacataatacagaagctcttattcgaagtgaaagaactgaacctcactctgctccaaagccagatctatgtcagcggagcctccattgacaatgatttgaagcgcatacggaagatgctggaaccctatcccggcttaaggctggtccgcaataaggaatgtatttccttgaagggggatgaggccggaaaacggcggttttacaaggatttactcatggccgaggtgcaggagaattttctcaacttaaacatgctggctaatttatacaaaagctttgacttgatcgaggtaaaggatatattcgtggatgtgctgaaggaatacggttattccattcatgaatccatgtttcccatgcttatgctgcatgccggtaccagcattgaacggatgaactgtgccaactacatcagcatggaagaggagatacaggatttggaggataccattgagtatcagatttctaaggatttttttgaccgcatctccaagcgtctccacataaagatccacgacagcgaagttggtatgttcgcccttgtggtcatgggcagaaaggcttccaattataccggtgatttcgtgaatttcggcggcagctggctcagtaccgggaaactggtaggcgaggctctgggacagatatacgccttgttcgggctggatttccgtcaggatgaggaccttatcgcaggccttaagatgcatattcacggactggttgagcgggtcaggaaccaggcccgtatggaggatgtgtttgtggaagggatcaagcgcaaatatcctctagtctttgagatgggcatctacgtggtagaatttctggaagaaaggcttgatactcccatatccgatgcagagagctgctatattgccctccatctgggagctgccagtgagcgcatgaacgcaggaaggaagtaccgtgccgtcatgatcctgccccacaaccagtctttctctgacatgtgcttaaagaaaatttccgatatgtttcgtgagaggatggaagtggtgaaggtctttggttattttgaagaggaggcagtatcctccctggatccggacctgctgctcagtacttttcccttagagcacggtttggctgtggagacagtttccgttaacctgtttgtggattccgagacagagtccagaattctacaggccatcaaccgtctggataagaaaggattccgtctggagttttcctcccacatgggcagcctgatccggcgggaacactaccacacagaggtggactgcgccagtccggaagaaatcatccgcatgctgtgctccggcctggtacaggcgggtgttgtggaaccggaatttacagatgtggttttaaagagggaacagatgtcccctacctcctttgtgaatacatttgcaattccccatgctttcggagcctttgccaggaattccgccattgcggtggctcagcttaaaaatcctgtgaaatggggcgtctttgaggtacggctggtgatgctgtttgccatcaacaaaggggatgccaggctgattaaaatcttctttgactggatatccaacatcgtgaatcagcctgaagagctggcaaaattagcggctccctgcgaatatgaagaatttattgaccggatcatggagtgaatttcctaagagctaggaaatgcatttaaggaaaaaaagtgaatcactgccttataatgataatcaataaaggcagcttaagttaagatgcagcgaacagaacagttttgctgcattttgctttttatcaatacatacaggaggcagcaatatgttagagggattagaaatgatttgctttaaaatcatatccaatgtaggcggggcacggtccagctacattgaggcgatccagaaagcaaagcaaggggattttatgggtgcaggggaatgtatcaaagccggtcatgaaatgtttctggcaggacatgaggcccactttgaactgatccagaaagaggcccagggtgagttggtgggcaattccctgatcctgatccatgcggaagaccagctcatgagcgcagaaagctttaaaatcatcgcagaggagatgattgccagctatgagaggatcgcagagctggaggagaaggtggggaatcaatgacgggaataaaaaaatgcaaatagcaaggaggattttacaatgaaacgagtgtatttattctgcagtgcagggatgtcaaccagcatgctggcgagcaagatgcagaatgtagctgacgaacataaccttcccattgaagtggaggcgttcccggacggcaagatcggccagatcatcgatgaaaagcagccggatgtgatccttttagggccccaggtcaaataccgctatggtgaaattgtggaaaagtacggaagcaggggtatccccattcaggtcattgaccagaccgattacggcatgatgaatggtgaaaaggtccttaaatcagcaataaaacttttaaaagcttccaaataacggctattaaaaaacagaacattaataatagcaaaaacaaataaaaacgggggaataacaatatgttaagtaaattagagtcaatactcatgcctttggcagagcggatcggaaagaacaagtatcttattgcaattcgtgacggcttcctgctgtccatgccgctgttaatagtgggttcctttttcttgttaattgccaatttcccgattcccgggtggaccaacttctgggcaaggttctttggggagaactgggatgcctactttgccaagccaaccgatgccacgttctcaatcatggcaatgcttgcagtcgttggcatcggctattccttttccgaacagatgaaggtagataagctgttcggcgctgccgtatcactggtatgctggtttttgatcatgccttataagatcatggtaaatgatactgccgtgtccggcattcccctgggctgggtgggttccaagggaatcttcgtaggaattattgtggcattcctgtctgtgcatatctatgcgtgggtcaataaaaaggggtggatcatcaagatgcctgacggtgtcccgccgactgtggcaaagtccttctccgccctgattcctgccggaatttccgtactggtgttcttcatcataaacattatttttgccatgaccccatatgataacgcattcaactttgtgttcaccatcctgcagactcctctccttaagctgggcaacacccttccggctatggtaatcgcttatattttcctccatcttttctggttcttcggagtaaacggcggttccgtggtaggggcggtattcaatcccatccttcagaccctgtctgcggagaacctggctgcatttcaggcaggccagccgctgcccaatattatctcccagcagttccaggatttattcgccacatttggcggctgcggctccaccttgtcgctgctgatcgcaatgctctttttctgccgttccaagcgtattaaggagctgggaaaactggcttttatcccgggcctcttcggtatcaatgagcccatcgtgtttggtctgcctattttgctgaacccaatgatgctcattcctttcatgctggtgcccaccatcaacattgtgatttcctacttctgtatgagtatcggcctggttcctctgtgctctggtgtagcaatcccgtggaccatgcctgtcatcctctccgggttccttgcaaccggctggcagggagccgtgcttcagttgattcttcttgttctgggcgtattcatctatatgccgttcattaagatgatggataaacaatacatagaagacgagaccagaaaaactgagaaaaccgacgatgacgatattgatcttaacgatctttcttttgatgatctataaaatgaggtatacggtatgaagcttattatgatatatgaccagattcagtcaggacttggaaccaaggacgacaccatggttccccttacagggaaaaaggagcccatcggccctgcaatcatgatggaacctttcttaaaacaggtggacggacacgtaatggcctgcctgtgctgcggcaatggcacataccttgccgatccggaggaggtcagccgcaagctttgtgccatggtaaataagctgcagccggatgtggtaatgtgcggaccggcctttaactatgcggactacgcacagatgtgcgccaaagtagcctgcgatatcaacgccaccaccaaggcaaaggcatttgcagccatgtctgtggagaatgcagataccattgcagcttataaagataaagtatggattgtggagacgccgaaaaagggcggtctgggccttaatgatgccttaagaaatatgtgtattctggccagggccttagccgacggtgcggacacttcagaactgattcatgaattctgttttaaataaaaggaggcctttgcaatgtggggtatgatagcaacctggcgtatggctgtagaaggaatcacaaagggagctgagatgctgaaagaaagcggcgacgcgggagatgccattgaggcggccatccgtcaggtagaggacttcccttactataaatccgtgggctatggcggactgcctaacgaggaaatggaagtggaaatggacgcagcctatatggacggcagcacactggatataggagcagtggctgccatcagggactttgccaatccggtgtcggttgccaggcgtctgagtcaggagaaagtcaacagcatgctggtggctgagggagccgaaaaattcgcccacaaggaaggctttgagcgcaaaaatatgctgacagaccgggcaaaggcacattacaggaagcggataaaagagatggcggcccaggcggccgccaaggagcttaaaccttattccggtcatgataccgtgggtatggcatgcctggatggaaagggtaagatgacggcggccacctcaaccagcggcctgttcatgaagaaaaaaggcagagtaggtgattctcccatatccggctccggcttctatgccgacagcaagaaaggagccgccagtgccacaggcttaggagaggatctgatgaaaggctgtatttcttatgagatcgtccgccttatgggagaaggaatgcatccccaaaaagcctgtgagacagcggtgaaccggctggataaggaactccgggaacgccggggcgaagccggtgatatatccctcattgccatgaatcctaagggagagtgggggctgccacaaatatcgagggattttcttttgcagtggtcacggatgagctggaacccacggtttatctggtaacccgcgggaggacggccgctgcacttatgaaaaagcctctgaagaatggatggaaacttatatgaagacgcgcatggcacctatagaggattaagatatgggatatggaaagattgaaaatgaatcagataagaagatacttgactgcgtggaccggttaaaggaccggttcatcagcagtgtcctggagctggtgcgcattgacagtgtggaaggggaggcttgtgagggagctccctttggcactggtgtgaagcgcgctctggaatgtgccctggatatcagcggacagctgggatttgacaccgtgaacctggatcattatattggttatgcccagtatggcaggggagaagactatgtctgcgccattggtcatgtggacgttgtcccggcgggagaaggctggaagcagccgcctttttgcggctatatggagaatgaagtcatttacagcaggggagtgctggataacaaagggccggtcatggcctgtctctatggtctggccgccattaaggaggccggacttacccttaagaatccggtgcgcatcatctttggctgcgacgaagaatccggatttgaggatctgaagtattatctttcaaaggagaggccgcccctctatggattcacaccggactgcaagtacccggtggtttacagcgagcggggaagggccatggtgcggattacaggcggtctgaagcagctggagtcattttttgactttgtaaacaaatattttatcggagccgggaatacaggtgacaggctggggattgacttctgccacaaagaatatggcacgatggagatgcggggatataagctgagtgtggttcctggcagtctgaatggtaagagccaggcggcctttgatgtcaccttaagctatccgggaggcgttaccatagacgaaatcatgaagcgcatggacaataaggtcggagtagaagggtttaaagcccaactcatacagaattttggcccggtggtattcccaaaggacacgcctatggttagggccatgcaggaatgctatgaactggtcacagggcaggacggtaccccggtgaccaccacaggcggcacttatgctaaggctatgccgggcattgtcccctttggtccaagcttcccgggacaaaaaggcatcagccacaatcccaatgagtggatgagcgtggaggacttaatgaccaatgcaaagatctatgcactggccttgtaccgtctgggacaattataacaaatggagcatgattatgttggaggcttgaagcaaatccccgccgcttaatctttttacaattcatctatcatatcacttgattatcggataacggataatcgttttcaatttatcgggagatgttttgcgtgggtcgcttaaatacaattcatggtgtttacgattctctgaaaggtcaagcttatatcccgaatcagttatgaaggtttttaaggtttgaatcgttgcaggttcgctgtcataagggccagtgtgcataatttgagcacaaagtccctcattaaaaatttcaagccgcgcaatagaagaatcgaggtttggtttctttttgactagactcttttttgccgcttcaaaaacttccggcgtaacaaaatcaggcatccgtatcatggaagtccagcgaaacgcgctcttttctgttatgccaatttcaaaatcgtctgcatcctttgaccataatccttccaatgggggaacaacaaaatcataataccctttgggttgattgccgcccattttactcatttttacagtataggacaagccgtatagaacttgtaaagcagtctggtatgcttcgcttttatttgggtcgcctcgcccatcaatcataatgaaaaccatttccggcacttcaatgacggacggttttgcgtcgggttgatataaatctttttgcgtctttttgaaatcagtcgccataggagatacctcctttcgcagttttattttgcttcttcaatacaagatatataacttataccacatataactggacagctgtatgtcatattaagatgtttttgtttaaatatcatttacccattcagtgtcaagcgaattaatattactgtccgttcgtcccggagttcgagcttcaaaagatctatatttatgtttttataaataatatcttctcttatcttttcccttcgctcttttcttatattctgaatatcatcacagacctccttgattccgggtgaaaaggaattttcatggctgttgaaaaccaacaaaaaattgtttgttaacaaagcgtgtcaagaagcttgcctgtatgacagaataaggataaaagaatatcgaaatataggaataaacaaaatgagatatataagcattgaattttacttttgtatgctataatattctaaatgatgaaatgatatataaatgaggcagcgcagtgctaagacaaggagaatgattatggcaattgaaaacgtaaaagctttttttaaacaatacaacatggatacccgaattcaagaatttgaagtgtccagtgcaaccgtagaactggctgcatttgcactaaactgtgaacctgaaagaattgccaaaacgctttcttttatggtagacagacaagcagttttagtggttacttccggcgatgcgaaggttgacaacaaaaagttcaaggagtatttttgcacaaaagctaaaatgcttttacctgatgagattacagatttggtgggacacgcaattggggtgtttgcccttttgctgttaaaagtgacgttgccgtctatcttgatatatccctcaaacggtttgaaacggtctatccggcctgtgggagcagtaacagtgccattgagcttacaataaaagaattggaaaaatactctggttattcacaatggattgatgtgtgtaagggctggaatgattaatttatggcagcttgccttgcaaaagcataaaaatgtgcagaaggagcgtttatggttaaaatcgattgtctgggcgatatgtgcccggtacctgttttgagattaaaaaatgtcattcattccataaaaaacggtgaagaatgtatgctggtaacggatcatagctgtacgattactaatattgaagctttttgcaaggcaaatgatttaagttatgctacggatgaagtcattaacggggtatgggaaatcaccatttatgctaacaaatagtctcttttagtattgtttcaatgtatttgatgagctttgaagattcacaattgagagggccgcttgctgcattttttacggaataatattcattatcaaattccaggcatggacattcaatgatacgaagctgcttattgtaaatttccttcttgatagccatataggggagaaatgcaaggccgaagccgttgattgcggacagtttaatggattccgtggattcaagagtataagggatatgcagctgattgatgcggattccgtttttgttcagcattttatccagtacctgtcttgttttttgggtttttaccagcatcagcagcgggtaatgataaagatcctggcagtctaactgggagggaaccttcattttttcccctgcaaccagaaaaacccggtcagaaaatacctttttggcagacagatttttatccttgggcttaccgatgataattcccatatcagcaaagccttttgatattttttcttctatgattctgctggacatcatttccatgttaagcgtatattccggatatttgttttttacatggtaaaacgtgcatggcagggcataagaatatacgcagggagaagcaaggatgtgtatggctttattttgattctgtgcgttggtgatatcagccaccattctgtcataggacgataatatctcaagagcgcggttataaacaatcataccaatgttagtgggaatcacaccctgatagttccgctcaaaaagccgtgcgctgaattcctgttccatgactcgcagctgctggcttaatgcggactggctgatattcatctgttcggcagttttagagatgctgccggattccacaatttttataaacatgttcaggttatgaatgttcatgttaacccgcctttctgaatttaaccccaaaccatttgattgaactgttaaaaacttaacagttctttttttgccctttcattatagcaaataagtttccctatggctagtgtgataaaataataggatataagtaaatcttatgacatatcagattcttgattaactggattttgataattgtggtataatttgaattgcgatttcgttattatattaacaaatactattttaagaaaggggatttatgtgtcagaggttaacacaagcgtaagtggggaaagagtgcgcaaaccaagaaaacccaaaaagagccagattccatatgcaattctggttacaatcctgatcattgcttttggattttatttggcaggagggaacaataagctgcctgtttactggggattcggtattgcattcgggtacatcctgcagcgttctcgtttttgctttacggcagcattccgtgacccgtgtattacaggaagcacatctgtaacaagagccgtactggtcgcagttgcagttggcagtgtgggattctgggcgatcaagtatgccagtgtcatggcaaatgcagaatccaattacagcatggccagcgtatcgcccattggtttgcccttgatcatcggtgcggttatgtttggtacaggaatggtcattgccggaggctgtgcatcaggaactttgatgcgcgttggagaggggtttgcaatgcaggtactgtctttggtatttttcatagcaggttccttctggggtgcacacgatatgaacttctggagcaaattcaatacaaatgctccgaagatatttttaccggacgtgtttggctggtttggtgcaatccttgtacagggattgatcattgtgctgttatacatagcggctgtcaaatggcaggaaaagaaaatgggaagtgcagaataaaataattttaaattaaaggagatataaaatggcagaatttacattagattgtctgggagaggcttgtcctgtcccgcttatgaaaactgagaagaagatcggtgagctatccgtaggagatgttttggtcgtatccattgatcatagctgtgcaatgaaaaatgttcctgagtgggcaagaaaacagggacataacgtagaaattgaagaagtggatgacggagagtgggaaattgtcattgaaaagacgaagtagataacttccgtgaaagcaggtgaataaatttgaaacaattttttattaagcttggcgatcatccgatttacaaaaagctgttaaaagaacccttaacatatgtgtccggtgcggttttgcttgcagtttttcaaatcgcccacttttctgccctgggcagcggttggggagtgacaagcgcatttgccaactggggcacctggatttacaaagcacttgggggcgacgcaagcggctgggtatactatgcctctgaaaaaatgcagaaagaactgaataccagctttatggcagacggcggttccatccggaatctgggcatagtgctgggggcctttgtggcaacgttatttgcctcgcagtttaaaatcaaaaagatcaagtctttccggcaggtggtagcggcaattcttggcggtttgttaatgggttatggagcaagacttgcaaatggctgtaatataggagctttatttactgcgatttcagccttttccttatccggatgggtgttcggggcatttttactggtaggtgcttttctgggaagcaaattattagccaaatattttatgtgatttgtaatcatggggcgatcatatttgattgcccctaaataatataaacgccctgccacaggaaaaaaacggctatggaggaagaataagaatattcagaaaggaacaggttgcaatggctaaaaaaacagaatcatatgatgtggtaattatcggaggcggagcggccggcttaactgcgggaatctattgcggcagagccaggcttaaaaccctgatcatagaaaaaaccctggtaggcgggcttgccacatataccaatgaaatagagaattaccccggttttcctgaaggggcaacggggcttggactgatggaattattccataaacaggcgaaaaaattcggtgtggagtttaaactgacagatgtgaaatccgtatccttagaaggggaggtgaagctggtagaaacgttccgcaccatttaccaggcaaagactgtgatcatcggaagcggcgggaagccccgtctgaccggtgcaaaaaatgaggatttatatctttatgataaaggaatttcattctgtgccacctgtgatgcggcggcaaataccgggaagaccgttatggtaatcggaagcggtgacgcagccattgaagaggggatatttttaaccaaatttgcagacaaggtgatcgtatccgttatgcatgagaatggcaaaatggactgcaatgagatcgcaaaggcacaggctcttgccaattccaaaatggaatttatctggaatacagttgcagatagctttgaaggtgacgaaaggctgcacacggttgtgttaaagaatttaaaaacagaggagaaaatcccagttcaagtggacagctgttttctgtttatcggttacctgccaaatacggaattattccgcggcgttctggatatgaatcggggaggttatctcataacaaatgagcggatggagacaaacatacccggagtatttgcagtaggagatgtgcgtgacaaatacttaaaacaggttgcaacagcggtgggagacggagccgttgccggatacggtgcggaaaaatatgtatcggaaagcgaaatatttgaaaaacagattatgaatgaaggcaaaccttcccttgtgtatatttataatgcaatcgatccccagtcaagagaactgctgccggttttcaaagagtttgaacaggagcattgcgactttagggtatcctgcatcgatatttataaatcagatggacttgcaaagcgccttgatgtggagaacgccccctgtatggtctggatcaaagaatgccagatcatggagaaatgttatggtgaattgacaccggagcgcattaacagcgtatgcaaatagaaaagatgccagggctgactattcgtgtatcagagagattgattggatcgtctatgaaaataaatttttggacttgttatttattgtaaatacatttacaatattttagagtaccaggtgatagaaattacgaatagacaggagcgtggctatgccgctgttaaatcttttaattaaacctgcatcaggcaattgcaacatgcgatgtgaatattgcttttatgcagatgaactgaataatcgtaccatccagtcctatggcaggatgtcggtgggtactttgcagacaattgttgaccggtcgatggtttttgcagacggagagtgtacctttgcatttcagggcggagagccgactttagcgggattggatttttataaaagtctggtcagttatgttgccgctcatcccaatccaaaaaaaatcagaattcattatgccattcagaccaatggctataatattaatgaaacatgggccgcctttttcgcagaaaatcactttttggtgggagtttctttagacggtatgaaagaaatccatgacaaataccgggccaatgctgccggagagggaactcacaaacgcgttatggcggcaatccgtttgctggaaaagcatggagtggaatataatatcctgaccgttgtaactgccgctgctgccagaaatggtcaaaagatgtacaattttttcaagaagaaccattttgaattccagcagtatattgagtgccttgatcccatcggtgaagaacctggcggtcatgaatattcgctgacaccggaaaggtatgaactctttttaaaaagtatctttgatgcatggtatttagaccggaaggccggaaaccatgtgtataaccgttattttgaaaacctgatgatgataatagccgggcagattccggaaagctgcagcatgcggggagtttgcggaaggcagtgggtgatcgaagccgatggaagcacatatccctgcgatttttatgcgctggatgaatggcggctggggaatgtgaatacggacagttttaaggatatggaacaaagaagagaggaacttgggtttataaaatggtcggaaaaggtacctgaagaatgcggaacctgtaagtggtatggtttatgccgcaatggctgccgcagaaaccgggagccggtaacctctgagaatacgggaaagaattatttctgcagtgcatactataattttttcgaatatgcgtatccaagattaatagagatctatcggaaattgatttgatttttatatcattgggagttctcatctgtattttttccatatgcagaaacggatcttataaaaactgcagcaatcgaaaggcttaaaaatgccttggattgctgcagtttttaatttattaacttatacttcgcccttgcataaaaaataacataaaaccaatggttttgctataattaaaattccgtatgctgacaccttgctggacggctgtaataatatttattccagtaacagcattcttctcgtaacagaaagagaaaaaagttgtttaaatgatgcgaaggaaaagaataaacgttctgtctgaattttattgtattaaactttttgtatacatacttatatactaacatcatttttattgacaacttaattcctaagtgctatattaatatcagaaattcaagtatgcaaaatcaattcacatatatgaattaagaaaagataccggtaaccttgtaaattaattggcgaggtgctatatttaaaaatgaattagtgaattaaattcatatatgtgaaaaggagaaacatatgggagttaaatctgcagaacgcgttttagaaatttttgagttattaaaagagtatcctgatgggttgacatcaaaagaaataggtgaagcgcttgggtatgctgcaagcagtacatttaatctggttaagacactactggatcagggatatcttttagagaatgagaacaaaaggtatacgctaggggcaaaattgattcagttgggggcgtacgcatcttcctatctggatttgaacaaaatagcagctcctgttttgaagcgacttatggaaactttaaaggaaactgtttttatggctgttttatctgatgaagacatcgtgtatgttgcaaaagtagataactaccgctctatttcaacgaatgcaagattaggcggaaggaaacctatttactgtacgggattgggaaaggcttttctcacctttataccggatgatcagcgagaagcgctcatagagcgtttgaaatttgttcccataacagaacatacaatcacaaaaaaggaggagttgtatgaccaaataaaaacatttaaaaagcttggttatgctgtagataatgaggagattgaagtaggactttggtgtgcggctgctccgatttttaacagaaatggtgagatggaagccgcggttagtgtatcagggccaacagaaagaatgagaggaaacaaagaaatgattgtgaatcttttattacagtcaacaaaagagatctcagaaaagttggggtacataagaaaatgataaaaagataagaggagtaaatatgggaagtttagcaggagtaaatccaccgtcaattacaatttttaatgagataggacaagtcaattatgaagcgatgaaacgccacacagattttatgattgaacagggtgttaatggaattgcttatcttggaacatcaggtgaatttggggttatgacagtggaacagaaaatagagctgattcaagttatgactgcatatgtaaatcaccgagttaatgttttggttggtgtcggagacacatgtttagaatatacgcagaaaatgatagtagcagcacaggaggcaggtgccgatgccgtattggcagttgctccgtattttagtatatatgctgaagataacatagaagtttattacagggaattggcaaaaatttctcagcttcctgttattgtatataactttccagatcttacagggtttgatatgagcccggaattagtgaaaaagttggcattgtcatgtccgaacattataggaattaaagataccgttccagagatggctcatttaaaagctatggtggaaattaaaaaagataagccagagtttatggtattttgtgcttatgaaacgcaggcatatgagatgatgaaggaagggattgacggttttatcaatgcaaccagtaattttgtacctcagtatacagtggggctgtatagggaatctctggaaaataatgaggaaaagatgcaggagtactttaaaaagatgtgtgtggcttcagaagtatatcagtattcgcttccgttgctgctggcagtaaaggaagccgtttaccagaaagtgttgcatcagtcgggagcggagaaattgccggggttgtcattaaaccaaaaggataaagaaaatattcaggaattgctgaaaaaactataggaggataaggttatgggaattatgggaagaaaaatcattgaaatcagagcttatgttgctgaagggggtggagcggattaccatgatcaagggcaagatcactggatcgtaaaacaaatttccacgccaatgagtatctatccggagtataaggcgactagaacaagctttggtatcaatgcattgaagacccttgttgttgaagtagaagccgacaatggggaaattggatttgggatttcaaccggcggttatccggcggcgtggcttattatgaaccatttagatcggtttattatcgggcagccggttgaaaatattgagcagatgtgggatcagatgtatcgtggatctctgtattatggaagaaaaggtatcgtaatgaatgctatatctgcggttgacttagcgctatgggatcttttgggaaaattaaggcaggaaccggtttatgccatgctgggaggtaaggtaagagaagaattgtcattttatgcaacaggaccgcgccccgatttagcaaaagaaatgggatttataggcggtaagcttccgcttgtatatggcccagcagatggtgaggagggactcagaaagaatgtgggacttgcagagaaaatgcggaatgctgtcggtgatgatttcatgcttatgtgggactgttggatgtccctggatctcccgtatgcaagaaagcttatgcatgagtctgaaaaattgggattcaaatgggtagaggaatgctttaatccggatgactattgggcatatcgggatttaaaaaaggcagcaggaaataccatgatggtatcaggtggagagcatgaggctacacgttatggattccgcatgctgatggaattttgtgatattgatttgcttcagccggatgtaggctggtgcggcggtatgaccgagctgataaaaatagggaacatggcagaaagttatggaaaaatggtagtgccgcatggaagcggaatttatagtcatcactatgttattacaaaagtaaatagtccgtttacggagtgtatcatgatgagtcccgatgcagatacagtaatttcacaatactatccgttgattaaggatgagccgcttccgatcaatggaaagctgaagataaaagatacgccaggatttggtgcggaactgaataaagaaggctgcaatctgattgctgtaaaaaagggaggaaggctttaaatcgtgaatgcgaaaggaatcaataaggataagatccaaagtgccttaaatttagttacatttcgtttgcagcatcttcaaaggccagaaaaagaggaagagctacttaagaatcaggaaaaaacaaaaaaggttatcggagcatttccaagggattttgggatggatgcgtgggactggcctcagggagtaggtttatatgggatgatgaatctgtataaaattaccggagatcaggacattaaactgtatattcagcagtggttccagaggcatatacagatgggactgccggtacgaaatataaatacaacctgtccgcttttgacaatggtagatttggtagaatctaatgaagaatacagggagatctgtgaggattgggcaaagtggattatgtatgaaatgcctagaacaaaagaaaatggttttcagcatacgacgactaaagatgcagccaggggtttgttgaacatgaacgaaaatcagatatggattgatacattattcatgacagtgctttttctcgcaaaatggggagtctatacagataatgaagcttatcagaatgaggcagtccatcagtatctaatcatgctgaaatatttatatgacaaagaagctggattattttatcatgcatggacctttgatgaaaacaagaattttagtaaggcattctggtgtagaggaaattgctggtatactgcttcggtactggattttatagaaatattaggagataagttaagtcccccagtgaaagagattttaatcgacgcttataaggcacaggtatctgcattatgtgagtatcagagtgagtcaggattatggcatacggttttagatgatccggatagctatgaagaaacatcgggatccgcaggtattgtatatgggatacttaagggacttcgaagtaaagtgctgacagcagaccatgtagaagcagctgagcgtgcggtgaatggaatcttagataagatcagttcagatggcacagtagaaggggtatccgccggaacacctgtaggaaggggtagggatcattataaaggaattatgatagctcccatggcatatggccagtcactatgtataatggctctttcagaggcattacaataaaattcaaggagagaaaattatgggaagatggagtaagaaggtatcggcagtagtactgtcaaccgcaatggtggtaggtttgactgcatgtgggacaaacgtaaagaacagttcatcacaagcgggaaatgagcagcagacagaaggatcttccaaacaacaggaagacactcaggagggcggagacaaggacgtacgccttaagataagctggtggggcggtgacagcagacatgaggtgactttaaaggcaatagaggtatttgagaaaaaatatcctaatattaaagtagaagcacagtatggagcctggaatggatggctggaccagctctccgtacaaatggcaggaggtacggaaccagatgtgatgcagataaactggaactggatttatgaattctccaaagatggagatggttttgcagatttaaaccaatatggggatgtaattgatctgaaacagtaccccgaaagtctgttaaagcagatgacaattgatggaaagcttcaaggaattcccatagcctccactggaaaggtgttctattggaataaaactacttttgacaaagcaggaatagcggttccggcttcctttgcggagatgattgaggcgggaaaggtattccaagagaagctgggagaagcttattatccaatggcattgactccgtttgagcagtcactggttatggtgtattatcttcagcagaaatatgacaagcagtggattgtggatcagaaggttaatttcacagaagaggaagtagctgacggaattgcatttataagaatgcttgaagataaccatgtattccccagccaggaaaagctggcaggagacggagcggatacaatggacaaaaatccaaactggattgatggaaagtatgcaggattctatgagtgggattcttcacaggctaaatttgccaatgcattagaggagggacaggagtttgtaatgggcggctacccttatgactatggtaatgtaaaagcagctactgtaaagattgcaatggcctttggagttagcgctcacagccagcatccgaaagaagcagcaatgttgattgatttcctgttaaatgatccggatgcaatagaaatcatggggcttgaacgaggggtagtatcgaatgtgaatgcgcagaagatactggagtccgcaggaaagctttctgatctgacctatgaaagtaatgtagcggcaatggagaatgcaggatttgcattggatccatacttcgaggattccaaattgaaagataatacaggtttatattttgaaatatttgaagatttaagctatgacaacattgatcctaatgaactggcggcaaggctgattgatgggattaataaagtacaggattcaaataaatagaatgtaaaactcagggaatcagtcttcaggcggactggttcccaaatcagaagataaacggagcgggcaggataggtatgaaattcagggtaatatttaaaacggcaaggaagattacaatcgaacttctggatgcggggattttttatacggattttacttatgatatatatattaatggaaagaatcgtatgaccagccgccgtgtagtggagactgttgatgggttgaaaccagatacagagtatacgatacaggtggtaggcgaaggtactaggtctgagactgtaaatgtaaggacagattatgaatttgtgactttggatattaagaaatttggggccgtaggggatggagctcatgatgatacccttgcaattcaggcagctatcagttcctgtcctctggatagcagagtgcttataccaaagggaatttacagggtatcctccatttttttaaaaagcaatattacaattgatttggcagaaggcgccgttctttccgcctttacggaacgggagaaattcgctgtcctccctggattaattgaaagctgggatgaacaggaagaatataatctaggaagctgggaaggaaacccattaaggatgttttcttccatcatcacaggaattggtgtaaccaatgtcgtgataacaggaaagggcgttattgatggcaatgccagctacaataactggtggaatgattttagaactattaaaggagcatatcgtcccaggatgattttcttaaataattgtgagaatatcactctgcatgaatttacaaccaggaatactcctgcatggaatatccatccgtatttttccaggaatcttagatttattggtcttcatattctcaatccgaaagtttcaccgaatacagacgggatggatcccgagtcctgtaatggtgtagaaattgtagggacgtatttttctgttggagatgactgtattgcaattaaatccggaaagatatatatggggaaaaagtacaaagaaccgtctcaaaatatcgaaattcgacaatgctgtatgaaggacggacatggttctgtgacattggggagtgaaatggcggccggagtaagaaaccttattgtaaaagactgcctgtttcttaatacagacagaggtttgaggataaaaacaaggagaggaaggggaaaggatgcggttatcgataatgttgtgttcgagaatatccggatgaatcatgtcttaagtccttttgtagtgaattccttttactgggattgtgatcctgatggtcatacggaatacgtggcttccaagaacccgctgccattggatgacagaacacctgtcattaaaagcatggtatttaaacatatcaaggctcacaattgtcatgtctgcggtacatttatttatggtttgcctgaggctaagattcagaatataacgatggaagatattgaaattgattattgtgataatcctacacctgaatttcctgatttgttggcagatgtagaaaaaatcacaaaaatggggatatatgtccataatgttcaatatttaaaaatggataacatacggataaccggtcaggaaggatcggcctggatcatccaccaggtagataacttttttaaagatggaaagagagtggaggagggggaagatgcctcaaatgacaaatttgaaacggaatttaaaaaggattttgcgcaataatgaaggttttttatatatattaccatggctaataggatttttagtatataaagcatatccgttcgcatcttcattgttttacagttttacggattaccatctgtttaatggaattagggagtttggattgatgaattataaagatattttcaatacaaaaaagatcatggatgcttacgaggttacctttaaatatgcgtttatgacagttccgttaaaactgatatttgctttattcattgcttatatattaaattttaaaattaggggagtgaacatatttcggacggcatattatattccttcaatcctgggaggttctatagcaattgctgtgctctggaaggccatttttaagaacgatggtattatcaatatccttttagggtattttggggtagaagggccaaattggttggccagccgtactcacgcattgtttgtaatctgttttttacgtatatggcagtttgggtcggccatggtaatatttcttgctgcattaaagggcgtttcacaggacttatatgaagctgcttccattgacggagcgggtaaatggagacagtttttcagcattaccgtaccgcttattacacctgtaatcttttataatctggttactcaattatgtcaggcatttcaggaattcaatggcccatatattattactcagggtggtcccagaggttcaacaacccttatttcactgttgatctataacaatgcatttaagagttatgaaatgggtatggccagtgcacaggcgtggctgctgtttcttattgtaatgacacttactgcaattgcatttgtaagtcagaaaaaatgggtttactattcggatgaggaagggagatagatgacatgaccagagatagaagaatgatgattaatacattttttcggtatttggtattgattgcagtaggtcttattatggtatatcccctgatctggatggtaggtgcatccttcaaaacaaatgctgaaatttttagcggaattgggttccttcctaaaaagcccaccttaagtggctaccagggtgctttaaaaggttatgggggagatatcaatatttttaaagctatgttaaatacttatgagattgtaatttcaaaagtagtgtttacgattacgtcagctactattacagcttatggttttgccagattccagtttaaaggaaagggtatctttttcgcaatccttatgtctactttgtttttgcctcaggttgttttaaatgtacctcagtttatcatgtacaatcagtttaattggattgattcgcctctgtacctggcactgattgtaccgaccctgtttgcgacggatacttactttgttttcatgctgatacagtttttaagaaatattccaaaagaattagaggaggcagcgaagattgatggctgtaattctttaaaaacattatggcatgtaattgtgccgatgttgaaaccatcaattgtttcctgtgccttattccagtttatgtggtcatccaatgatttcatgggcccgctgctttatgttaatactcctgccagatatccggcttctatttttgttaaaatgtccatggatgcagatgcagggtttgagtggaacagggttctggctatgtcaatgatttcgattataccgtcattaattgtttttttcctggctcagaaatcttttgttgatggaattgcagcaggcggagttaagggataggtttataggatggagatgacagtggataaagtagtaaaaaaatatgtagatgaatatttagatgagtgcaaggactggaatgagaagactattatggtccttctgggcttgaaagccatgtatgaggcaacgaaggatacttattacaaagagagaatccttgaatgcatggaaaggttcattgatggatatggatatacaaaagatcttaatggcattgcctctggtcgagtaatggcaggtgtcaggatattagattttgcttatcagatgaccttgaatgaaaaatataaaaaagctatagagcagaccgtacaagcgtcagtagaagcattatatctgtttcccgaagaattttacatgacggaaccttcttatatgttatatgaaacaatatataataaaaaggaaggatataatcggatacacaatcattttaaggaattagaagcgtatttactgaatggggtttctttgaatggtctgggctggtacatgatggctttaattgattcatttggaatcatatcagagcagatttttgaacagatgaagtatattcagaaactatttaaggatcagttaaaaaatatcttggagaagaacattatttggaatgatcagagtgagctggttgcacttatgatatcttattctatcatgaagagttgtcggttagaggctatttcaaaagaacgatattatgatgttggagcagatatatatcaaacatttctacgaaagatggaggagaaagaattaggaagcgtgttacaggatgaaatatttataagtacttttatgatggcttatagtgaagtcatattgaaaaactaaaaatatgatttcatgtcattgtgcgaccaatgtcattaagttaagcgaacgtaatgcagccaataaggagctgatcatgtagcaatacatggttggttctttttttgtttgtccgccataggcgggctctaatacaatgtcattaagttaagatatgagccatacttctgaaaaagagatatggattttttatttcatacttgacaaactgccatacatatgtgggctctttactgatcaaggattagtaaggtgccccttgcaattagtagatattttagctaattacaaggaggtctcgtacaaataaaggataattactctcataaaaaacactgtatagattaattgataaaagcagtaagaatataaatgattttgttcaaaattccaatcatgatcatactcgcaaacgaaagatttcttttgaagacactattcacaaaatgcgaatactacctgtttgatgaatgtaactgtgcttactccttagtccgtttttataaagtctcttgttatagaaagcattttgtatgcttccaattatctaaagtaaaacattttttcatacataattcaatgagcagaaattacagaggaaagaagctgtgcttattttacgaaccatgtatgttggatgcctatctcataaattcctcattcgatagttgcttcctatgcgggtcagcctttcgataaactttttgtcagacgccgctcaggtttggtgctattaaggtaccataccaacaacattttaattagacataccggaaaggcaggtggttctttgaaacctttcgaggcttagttatctcctcataaggaattccggtacttaagcggagtcataccataataacgctggaacatggcaatgaatttactgcagttatggtatcccacctgttttgaaacatcggcaacggatagagaagcttcgctaagcagattgcaggcaatggacattctaagagaagtcacatattgatggatggacatgtgatacagatgggaaaatcctgcctttaatttctgcgtattcaaatacacccgcccggccagttcttttatggtgggcggggtgcaaacttctaaagtgagaatgttgtgtgcttcgtgaagcgctttttgatcgctttcacttaacagtatatttttcccggaaggtaaggtgatgatcagctgggatggctctgagaaagttttcggaataatcttttgtgagtaggttttggtaagctccgatatgatttccaatactttaccttctatgagcataggggtaagcgtgcccaggtttgcgttatattcaaggttttggagaagctgtagcagtatgggagaaaatgaattttgtaaaaggtcgggaggaagatcctcaaatctgatgcagtaaggggcataagctttcgctaagtattccttaaagtatctctctcttataacaatttccgctgcatgataatgctgccccctttccaggtctgggagccttttctgccggttcctgttaataaaaatgaagtgggacacaatttaaataagggttgtcccaaaagctggtattcaccttctccttttaaaagattgctcatctggaaataacgctcttcaatcgaaaactttagtgagaaagtccgggcaggcgtgtaattgctgatgaataacttataatatccctctttctcaaagtaataaatcttccccaaatccggtttttgcgggtgggagtatatggaataaaaccccatatttttttgttcaaattgaagctgcttaaaaaaaccggcatgataatcatccatattcttatatatcataatagtaagttcctctgtattctatgcatttctctgtattatctcattttagcccttaacagaagaaattatatcccaatcagatgctgcacttgacaacccatatcttattcgttataatcaaccctgttctgctggttagtctgttctaactattgcattataggttattttcctatgcatgtaaagaaacttttatgaaaaaacacatgcagaagccggcagaacatagaaagattcggaggaatatccatggaattaagtgcaaaagggctttccctgtgttatgaggggaaagaagtggttcatcagcttgatgccggagtcagagaaggaaaaattacagcattaatcggcgcaaacggcagcggaaaatccacccttttaaaaggctttgcaagactgttaaagccttcagccggagaagtgctgctgtttaatgaacctttggcggcatacgacacgaaagaaatcgccaggcatttatccttattgccccaaagtcctcaggcacccatcggaatcaatgtctttgagctggtctgctttggcaggtatccttatctgaaaagatataaaaacgatctgacaaaagacgattatataaaagtggaagaggccatgaaattgaccggtacctgggaatttcgttacagggatattaatgctttatcaggaggccagaggcaaagggcctggatcgcattgaccctggcacaggacagtaaaatattattgctggatgagcctactacgtttttggatttaactcaccagctggaaatactgaagcttttaaagaaattaaatcaggagtttaaaaagacgattgtgctggttatccatgatttgaatcaggcggcaaggtttgcagacgatttaatttgtttaaaaagcggagagatattgtacagaggagaagtcagggatgtatttaccagtgaaatgctgagagatgtatttcaaatcgatgcaaaaattgttcttgacccaagaagcagcaggccggcattcctatcctatgatcaagttgaaaaggcataaaaaatgcagcataagagtgaatacatgaaaaaaacagataatggaaaagacttgcaaaggaggctgtacaggctgatatttgccttaggtatccttacgtgctttcttataacagccagtttactggtgggactaaaaaattactcctttaaaacactttgggaaagtgttaccgcatatgacccttttaatcaggctcatcagattatatatacagtacgccttccaagaatcataggcgctttattaacaggaaccatacttggaatctgcggactgatcatgcaaagtatcagcagcaatccattaggagacccttctctccttggtgtatcagggggagccagtgtggtaattgcagtcagttatgccatcagcatgaatattggttccgttcagcgttctgtcattgccatggcaggagctgcacttgccatgatatttgtcagtcttttatccggtaaaatgggaagaagaacggacccccttaaactgatgctggcaggaacggctgtttctaatttctttgggagcttatctctgatcataggaatcagaagcaaaacctcaaggagtttaagcttttggatagcaggcagccttgccgggatcaatgcaacggacctcttatttttgacggtcagcttaatcgtaattcttctcatcattctgtactaccggaaagattttgcactgatggttttaggagatgagctttcaacgggactcggggctaatgtggacagagcacgcaaagcaggacttctggtggtggtgatcggtacaggaatcagtgtttctgtaatcggaaacgtaggatttgtcggactgtgtgtccctcatattgcaagactgctgtttggaagccgtttttctttcctgcttccggtggtagccgttatgtcggcatttttactgggagcagcagatttcatggcacgttcggccagcgcgcctcttgaaattccggtaggtgccattaccgctctgatcggtgcgccgttctttttgtatctggcgagaacgcagaaaaagaacggaggaaggactgcacagtgaaacaaaaagaaaaggatgtaagatatcttgctgcaaaaaggtgcagggggatattgaccattggtattatattaatcgttattacagttgttatttcgctcaacatgggagccatctccatctcccccggtgatatgatccggacattggcaggatttggaacgcctaaaaaccaattggtactgttttctttccgtctgccaaggctggcaatgattttcatagtgggtaccggtatggctctcagcggagctcttttacagggcattaccagaaatgatctggttgattcgggagtcatgggaatcaatgcaggagcaggcctctttgtcgtgttatacattttcttttccggcggtgatgcacagatagtaaagaccacccagtattggatgctgcctgtgacagccataagcggagggctgttgacagccatgatcgtctatgtgctgacctggaataaaggaatatctgccataaggctgctgctaacgggcgtggccgtaaatgctgtcataaatgccttgattttaatttttcagttaaaaatgaatgaatacaattttaacagagcaatggcatggctgtctggcgatatatggaaagcagattggcccctgatcacccttcttggcggctggaccctgatcctttgtattcttttaaacaggcagacacaggagcttgatattctgagattgggagatgagtggggagtaaccttaggagttaagacagaaaagagcaggcttctgcttttattaacggctgttgccttcgcctccatagcggtggcagcagggggaaccatcagttttctggggcttctttcgcctcatattgcacgaaggcttacaggaggattaagcagatactacctgcccgttgccgcatgcattggaataggaatcaccttgtttgctgacgtatgtgccaaattcatattttcccccgatggcatacccattgggttaatggttgctatggtaggcgcgccctattttatctatttaattgtaaaatataattaaaaatatatgtaattgaaagaaaggatgccgctgaatgatctacgcggctgtactgcgaaaaaatgtagtatatggtattgaaaatgaaacgaatgattcatgtgctgacaggcctggctttgactgctgccgttttaacaggctgcggagcgaataatggaactgctgtacctggcgcatcacaggcctctgaacctaataaaggcggaacccatacatttaaagcagtaaatggagacgtagaaatccctgatgatccccagagagtagtagtgcgtacttatcttggtgaagttatggtattaggaatacctgtcgcaggaagtgaagaatggagtcttgcaaatccttatattgatgaagaaaagaaagctcagataaaagatgtcggctaccccatgaatgtggaagaggttcttgctctggatcctgatctgattattacggattcagaagaaggtttggctgaaatggagaagatagcacctactgtttttatcccctttaataccaacagagatattaagtcctccattcgttattttggagaaatgttaaataaacagtcagaagcagaagcctggattgctgaatttgaaacagaagccgctaaggagacagaacgtttaaaggaagcgggaatggatatgaatgccagtgtgggtctctttgaatttgccaacggtaaagtatatgcattcggagataatatgggaaggggcggacaggttttaacatcaggacttggcctgaaactccaggaaaagttacaggaagtcagtgacggacagggctgggcagaaatatccatagaagcactgtcccagtatgcgccggattatatgtttgttactgtttacactgcaaatggggaaccaagtaaagatgtagaagagatgaaaaaaacttctgtatggaaaaacctctctgcagtacagaataacagggtcattgaattgccctttgaacaggtttattactatgatccgattgctgtgctgcagcagttaaaaatcgtaacggattccataataaatacaatgaaataatattgtgcttataaagagcaaaacacctcctggctgcacagcgtgcagggaggtgttttcttatacccaatcgttttattcacagcagaggacttgccctataaaactggattccctgttgctgtttccgtagttatcagctgtctcgcttgtttgagcctccgcacttaagaccgcagcaatttcatgcatgatccactcaaggtcgatcagggtgatgacacggtcatccgcttttgctatgccgatgacaatgttgtctttgtccccataaagctccgaatccggcttttcgatggtttcccacgaaatccggctgatggcatctgcctgatggacatgaaaggccatgcccatctgtttaaatcccataataatcaataagtcatgttcaggatctttcgaagcaggaagatccagatattttgcaagatccaccacggtaaacgcttcacccctaagatgtaccgttccttcgatacagggattggaatgggggatccgctgaacatcctgataccatgccagctcctgaatctttgcgatgttaataccaaacgtgttaccggcaactcctgttaccagcacctgcagttcatttgttgaactcattctttcttccatgatacacccttccttttagctgtcagccgagggagcatgtttaggttctagatgccgggttccatgggactccggctgacaaaactgataactccccaatgattctttccatattttagtatcttccaaaaggattattttaatccacattttgattatattatttccctttcttcttatgccagtatatctattttatatttttcatggattatgcgtgtagtgaattggcggtttgatatcctgaattgagtgtaatggaaaaattttcctcttaaaagatatccgacagcttttattgagaaatgttattaataacattaagcacataagaagcttcatcggatacattaatactcctatctggtgaaaaaagtcgtatattgtaacataatgtcatccattgctttgaaagctaattgggaaaagccatggagagtcaaaaactactaaggaggaaagagttatgagctatgagggtaaacgtttatcgcttcaggcaaaggggatggttggaggtagggggattgatcgggaaattgggtctatgatgggcaaatcagggcctttatgatggaaaagtgttaaaagaagtgataatttaaatataataaggcggtgttgtaatgagaaatctcaaattacatcttaaactaatcataagttttgcagttctgatattattttctgttattatagctattgcagcaatatcaagcatgagcactatgaatgcggcagaagataccttgtattcggagcagttgacaggggttgaaattgcaggagagatcagccagaacttttatcagcaaaagacgtttatacgcaatattgtaatatacgaaccggaagatgaatcatttaagcaggctctgtccatgctggatcagctggataccgagatgcatcaattatttgattcatatcaaaagacgataaataatccggaggatcaggtgaattttgatgaattcaaaaccatttatactaataattttgctgctgcaaaacgtaaggtaactgattctggcaagataaatgattccgccggtgccaaaaagtcgatggatgaagctgcggcagacacggaccggataacagatttgctcaatataagcagggatatgaataaaaggtatgcatatgaaatgctgcagtccaatacacaaacatttcaacgttccaaaatattgatcacccttatcctgctcatctcccttttggcaggggttatccttactgtttacataaccaaaattattgccggccctattgggagactgaaaaaggtgatggaacagattgcagccaccggtgcgctggagtttgaaaaggatttacaaatggaactggataatgataagcagtttaaggatgaggttggtcaaagtatagctgctacagaaaagatggttatgcacatcgtgcatatatcagaagagctaaaagtcattgccgggaaggatttaagcagtgaagtgaaattattgtcccaacaggatgtattaggcatggcattactgacaatacaagataatttaaatcacctgtttggggaaatcaatcttgctacggaacaagtggctaccggcgccgtgcaggttgccgatgccgctcaatcattggctcagggcgccacagagcaggcggcaactgtgcaggaattgagcatgacaataaaaggcgtttccgaagagatgagaagcagtgctgctatggccggcgaggcaaaaacaatgggagatgaaattcagcaaaaggctgaatcaggatcctcaaaaatggaagaaatgatgctgtccacacagcaggccaatgctgccagcaaagaaattgcttctgtgatcaagattattgatgaaattgcatttcaaaccaatatacttgcgctgaatgcagccgtggaagctgcacgtgccggtcagcatggaaaagggtttgcggttgtagcagatgaagtgcgcagccttgctgcgaaaagcgcggaggctgcaaaggatacggcagcgctgattgatacgaccatagaaaaagcggcccagggttctgtaatatccagccagacatcggatgccctgcaaaagattgtggaaggcgtggtccaaagcagtgaggttattacaagcatttcccaatcagcaggtaatgtggcagattccatgatacagatcagtaaagcggttgaacaggtatcccaggttgtgcaggccaatagtgcttcctctgaagaatgtgctgccgtaagtgaggaaatgagcggacaggcagctttactgaaagagacaattgctcagtttaaattaaaagaagactttcagggcatcagaattggaaacacattatatccaatgaatcagcaaatttccataaaaccttcaccggaaagcatgggattttccatggctcatagtaaatactaaaatacaacccttcttaaatgacctttatgagcggtgatttatagtcctttccacgtgaagctgcggtttttacggcgcctggcatgttgacgccggaattccatgtccggaataaggatatcaaatggacgggaattatgtgcataaaatctgcaaaccatgcggtgcttatctgttgataggtgccgcattggttttggaacggtttcgtaatattgtggtgccaatttcagaacgaaaaatgctgtatccaatcaaattgaatattaggaacaaaaattgtatatatgaaaaaaagatgcttgcatcttcgtgagagaaggagtagacggatatgatagaaaagctcgacatcatgttttcaaaaatggtttacaggaagactttgcgaatccttcgcagaggggtgttgtcgatgatgccgctggtgttggccggttcggttgtttttgctctgcttaccttgccgattccgtcctatcaccgctttatgtctggtatatttggggaagcatggcaggaaatcggcctgtcctttcattatgccacacttcagatcatggcgcttttggcgttgattgcggtcagttatgccgcagctaaggaaatgacacttgtaaggtccggtgaggtaagctctgtcagcattgtgattacggtatttgcctcctatattgcacttacacacagaaatctgattgtgcaggcacatgaagcaggttcctccggtatgttcaaggcccttttcgtatccatagctgcgtcccatctgttttgttttttttataagctctgctgccgtaccctgccctccaatgtcattccccatctgggaggcgctttgactcaggcctcctttctggccgttatgccatcctttctcactgtttttgtgttcagcggggcaaaagttttgctggtttctacaggtataaattcatacccagggatactcctgcaaaggataaatgaaacatggatgacaggagcaaactttgtttccgccgtgttgctgatccttttaacccatatcctgtcattctttggtgtgcggggcgaaccaatgatagcagatgcagtatccggtgcaaccagggtcgttacctcttttgagggtccgaatattcttaccaagggattctacgatacgtatgtgtatttaggaggtgttggggcaacactgggattgctgcttgcgtttctgctggccggtgagaataaccgtcttgtgaagatttccgtaccccttggtatttttaatatcaacgataccgtgctttacggttttccggtcatcttcaattcctattattttattccgttccttttgtcacctgttatccttggattaaatgcatatcttgccctgcttttgggctttgtgccgccagtcacacaggcgatagaatggacgaccccgatttttttatccgggttacttgcctccggatcggtttccggagttatactgcaggtgataaacctgacggcagctgtgttgatttacctcccttttgtccggcttcaggcaaagaatcagcaacgtgaccgcctgactaccttccatgttttatcagaggagctgcaaaatacctgggaaaagaggcaggaaaagatcatttcccgccatgacgatgttggtttgctcgcccgcacccttttggctgaaatcaggagcagcctccagggctgtaaaagaagcctgtatctggaataccagccaaaggtgaactattgcggtgaggttatgggaggtgaggccctgctgcgctggatccatcctgtgtacggatacatatcgcctcatattgtattaagcatctgtgatgaggccggacttaccaaccaattgggcatttgggtaatccgcaaggctctgtctgatttgcggcgttggcaagatcaaggatatggcggattatccatttccatcaatttaaacccgaatcagctgaaggatgacgatacgctgattgaaactgtggagagactgatcaatgaacatggccttaagcccggctgcatagagtttgagcttacagaaaatgctgcagttgatcccggcgattccacacgggacaagcttaagcaaatcagggagctgggtgtggatatctccattgatgattttgggatgggacacagttccttattgtatttgtgtgatttccatgcaaatattgtgaagatcgacgcttccctggttcaccgcattgccagcgacaggaggcggcagcagattgtggagacaatccttactctctgcaaacagatgaaggttcaggttgtggcggagggagttgaaacaaaagagcaggtccaaatgctccatgaacttgattgtgattactatcagggcttttatttcagcagggccttgagctgcgataaatttatggaatatgtgaatcagcacggcatatcagagaataaaaagatggaaagcgttacggcgagatagaaatgctttaaaagccggcagcgcaattgtcagaatcatggggaaaggttgtgtaaaaaatcattgacagtgccaaaatactctgataatatcaataataaataacggatgatgaatacgagagagagcacaaatctgtgccgccgaaggggaaggcagaaactctcaggcaaaaggattgtattcggacgtaactctggagaacatttatgtaccgaagaagtcaatctttcaggtaaaaggacagaggcagacagaaatatcttatacggatatttttctctgcctttttttgtgcagataaacggaagatgttcctgattatgaaaatagtaagatgtctttataaccggatggacggcagtaaaagacactgcctttatcatataaatttaaggagggtttacacatggaacgaaaaacaccgctttatgaaatgcatttgaaatatcatggcaaaatggtcccctttgcaggatatcttcttccaattcagtatgaagagggaatcataaaggagcatatggcagtgagaacaggagcagggctttttgatgtttcccatatgggagaaataagctgtaagggaaaagacgcacttgagaatctgcagcggctgctgaccaatgattttaccggtatggcggacggccaggcaagatacagccccatgtgcaatgaccagggcgggacagtggatgatctgatcgtatataagaaaaaagaagaagattactttatcgttgtaaatgcttccaataaagataaggattaccggtggatgctggaacataaattaggagaagcggtgtttgaagatatttcggatcaaatcacacaaattgccctgcagggtcccaaatcacaggaaatactcatgaaactgaccacagatattcctgaaaaatactatcatgctgtttttgatggaatggtaggagggatcccatgcatggtatccagaaccggttacacaggggaagacggttttgagctttatttggacaatacatatgctgagacgatgtgggaaacgcttatggaggcaggtaaggaatacggactgatgccctgcgggctgggggccagagacactttaaggctggaggccggcatgccgctgtacggacatgaaatgaatgatgagataaatcctgtggaaacaggtctcgggtttgccgtgaaaatgcagaaggaggattttatcggtaagaaccatttgccggataaggattcccttacaagaaaacgggtaggcttaagggtgacaggaagagggatcattcgggaacaggaagatgtgcttgtaaacggaaaaaaggcaggctttacaacatcaggaacccattgcccatatttaggctatccggctgccatggccattttagataaggaatatataaatacaggtacaaaagtaacagtaatcgtgcgaggaagagaagtagaggcagaagtagtgccccttccattctataaaaaatcaaaataattaatccaggagaaggagaatcagtcatgaaggtattagaaaatctggtttacacaaaaacccatgaatgggtaaaatttgaagatgaaacaaccgctttggtaggccttacggattatgcccagcagacattggggcagctagttttcgtcaatcttccggaagaggatgacgagacggcagccggcgaagtatttgccgatgtggagtctgtaaaagctgtttcagatgtatattgcccggtaacaggggttgtatcggaaatcaacgaagagcttctcgattcaccggaaaagatcaatgaggctccttatgaagcctggtttgcaaagataaccggtattacggaaaaagaagaattcttaaccccagaggaatacgaggaacttgtaaaaaaagaaatggaataaaggagatctgcatatgggttcatttgtaccggcaaccgatcaggacagaaaagaaatgctgtcggcgatcggcattgatagcatagaagaacttttcaggcagcttccccaggaagttctgttaaaggaaggattaaatcttcccctggtatgtctgaaatggaagtttgtaagaaaatggaaggcattgcagcaaaaaatacggtatttccggtcattttcaggggtgcaggggcgtacaggcactatattcctgctgttgtaaaaagtgtgttatccaaggaaaccctttacacggcctataccccgtatcaggcggaaatcagccagggaattttacaatccatatttgaataccagaccatgatctgtgagcttacaggaatggatgcggccaatgcttccgtatatgacggcggtgcagcggcggcggaagcggtagcgatgtgcagggacagaaagaaaaacaaggcttttgtatccacagcggttcatcctcaggtgatggagaccataaagacctattgctttggaaacgggatggaactgactgttattcctgagaaagatggcataacggatctggattttctgaaggaacatattgacagccagaccgcatgtgtctatattcagaatcccaattattacggcagcttagaaccggcagctgaaatcggaagtacagcaaaggaatccggggcgcggtatatcatgggtgtgaatcccatttcattaggtgtaatcaagactccggcagaatacggcgctgatattgcggtgggagaagggcagcccctgggacttcccctggcattcggcgggccgtatatcggttttatggcatgtacaaaagaactgaccagaaaactgccgggaaggatcgtcggagaaaccgttgattccaacggtaaaacaggatatgtcctgacccttcaggcgagagaacagcatatccgaagagaaaaagcattaagcaacatctgctcaaaccaggccctttgtgcattggctgtagcagtttatctatctgctatgggagccgaaggcttaaaacagacagccatacagtgtatgtcaaaggcccattacatggctgaccagctggaagcaatcgggtatccggttgtaaaccggggtgaattcttccacgaatttgtgaccgcttcaatagttccggcagaaaagatgttgagtgcactggaagaacacggaattctcggcggttatccattaaccggtgaaagaacggggcagatcttatggtgctgtacggaaatgaatgcaaaagatgacattgaccgtgtcattggcattttaaaggaggtgtaaggttatgctgatatttgaaaaagggcaggaaggaagatcgatgaccattctgccggaatgtgatgtgccggttaaactgccggaggaaggcagtttaagaaaaaagagcctccgccttccccaagtgtctgaaaatgatataagcaggcattatacggaagcggcgaaaaaggcatatggcgtcaatgacggcttttatcctttaggttcctgcaccatgaagtataatcccaagatcaatgaaagcatggcagctcttccgggatttgcacagattcatcccatgcagccggagcatacggcacagggctgtatggaagtgctgaaaacggcagaaaagtacttatgtgagatcaccggaatggaccgtatgacctttcagccggcagcaggagcccatggtgaatttaccggacttttgctgatgaaagcataccacgaaagccgcggtgataaaaaaagaacaaaaattatcgtaccggactccgcacatggaaccaatccggcaagcgcatccatggtgggcttttcggtaatcagcattccgtctgctaaagacgggggagtggatttggaggaattaaaaaaggcagtcggggaagatacggccggactgatgctgacaaatcccaatacattgggactttttgacaaaaatatattggacattacaaaaatcattcatgaagccgggggattgacttactatgacggtgcaaatttaaatgccgtcatggggctaatcagaccgggagacatgggatttgatgtggtccacttaaatcttcacaaaaccttttccactcctcacggaggcggaggtccgggaagcggaccggtaggctgcaagaatcttctggccgaatttttacctggcagcatggtagaggaagaaaacggatatacgtttaaagatcctgttcaaagcattgggcaggtgaaaaacttttacggaaatttcctgatcgtagtcagagccatgacgtatttattcatgcttggaaaggaaggagttccggaagctgcaaagcatgccgtactgaatgccaattatatgatggcaaaattaaaggatgtatatgatatggcatatccgggaccctgtatgcatgaatttgtcatgagcctggccaggctgaaaaaagaaactggcatatccgccatggacatagcaaaaggacttttggacaatggcattcatccgccgaccatgtatttccctctcatcgtaccggaagcgttaatggcggaaccaacggaaacggagtcaaaagaaactttggatgaagtgatttcagtattacgcggcttgcatgaaacggcaaaagcccagccggatacccttcatcaggctcctgttcacactccggtcaccaggctcgatgaagtaagggcagccagaaatccaatactaaagtatgatttttcagataaggaaacagataaagatgatacaggaaattaaatacgtaaacggaagcagtcatgacccgtatttaaatcttgccatagaagagtatttattagaatcagtaagtcgggatacctgcatcttatacctatggcagaatgaaaataccgttgtgatcggcaaaaaccagaacccatggaaggaatgcaggatcctggatttggagcaggcaggcggccatctggtaagacggctttcaggaggcggcgccgtattccatgatcttggcaatttaaattttacgtttcttgtccataaggatcattatgatctggataaacagctggaggtcatcttacgcgctgtcaaaaagctgggaatccatggggaaaaatcaggaagaaacgatattaccgtatcaggcaggaaattttccggcaacgccttttacaccagaggggagaagtgctatcatcacgggaccctgctggttcatgcagatatggagaagctttctaaatacttacaggtttcaaaggataagctggaattaaaaggagtggattccgttaaggccagggtaaccaatctttctgaatatcaggccggccttaccattgatatgctgaaggaaaagcttttggaggcatttgaagaaatctatggatgcaaggcggttttctgcagccaggaggatttagaccaggaagcgctggcccagggaagaaagaagttttcttcctgggattggctgtatggacgcaccatggattttcagtatgagctgtcaaagcggtttgtatggggaaatgtgatctggcagttccaggttaactgcgggatcatacaggatctccaattgttttcggattccatggagccggatcttgtggaccggatcccaaagtatttaaagggaagcaaatatgagaaccaggatatctgtaataaactggatcaggtgcctgcaaagacccaggcccagtcgatcatgataaatgacctaagagagttttttgctgctgcagaattataaaagccagggagggataggatggaggaaatatacgatctgcttgttattggtgcaggccccggaggatatgtggcggccattaaggctgcaaagctgggaatgaagactgctgttattgaaaaacgggaggtgggcggaacctgcctaaaccggggctgcgttcccgcaaaagccatgctgcacgctgccaaattgtatcaggaggtcctgtccggagaacggtttggaatcatttcaaaagaggtgacctatgattacggcaaagtgatgtcctataaaaatgaaacttccgaaagtctcagactgggagtggaacagctccttaagggaaataaagtaaagcggatccagggaaccggaacactgacaaaggatggaagggtcaggatcaggacagaggaaggcgaagaaatccttcaggcaaaacatatcctgctggcaacaggctccaagccttctctgccgcctattgaaggaatccgtcttcctggagttatgaccagcgatgagctgtttcagcttgatcacgtgccggagagcctgctgatcataggcggcggggtcataggagtggagtttgccaccgtattctcttcctttggttccaaggttacattactggaagcggaagacaggcttctgcctggcctggataaagaaatctcacagaatttaaagctgattttgaaaaaaagaggcgttgacattcataccaaagcatttgtgcggaaaattgaaaaggagggccgggattttatctgcacctatggagagatggcaaaggataaagaaaaaattgaggttttaaagacgccatacctgctttctgccgtggggcgcattcccaatacagacggcctgctggaggaaggggcatcactggaaatggaccggagcaggatcgtggtaaaggataattttgaaacaagcatgccgggggtgtttgccatcggagatgtgatcggagggattcagctggcccatgctgccagttcccagggcatctgtgcggtggagcagatgaatgggaaggagccgaccatcgatctgtcggcagttccgtcatgtgtttattttgatcctgaaattgcatgcgtgggaatcacggaagacgaagcaaaggaaaagggaattgagacccttacaggaaaatttttaacccatggcaacagcaaatcatttataacaaaagaagagagaggctttgttaaggttgtaacagataaggagaccggcgtattactgggagcgcagatgatgtgcgccagagctacggatatgatcggtgagatgggaactgctattactaataagctaactgcagagcagcttttaaaagctatgcgggctcatcccacctataatgaatcggtaggagaagcgctggaggaatgcattggcggagcgattcacgccctgccacgcaggtaattagttttaaaaatacagatatgataaaaaaatatatcggttctgccttcataaggaaccgatatcacaattcctgttaatgtcatcaaataaaccgtcaaatttcgatatgaagtttgacggtttatttttggtgtgcccggcgggcgcatgttctaatgagtgcaagtctcgaatccgcccggtagtgggaaggatatagccaagaccaagggtgtcgtccgtgagaacgaatctgaaggaaggtggaggcaaatctctggtctgacgaatagaaatcttatcaggctgtaaatgggggtaaggttgccaaacaagccaaagcccaataactacacggaaccatttgcagtaaataaggcagatagatggagagaaagagcatgcgagtacccggggagatctcacggacgtggagagtttttttttacgaacgacggttgaaataagatttatcgtgagaagtcagcagaaaccatagtaccatgccagtcgacgggtatgggaagggtggaactttaggaggtgggagtaaatgaatgttaccgaagtcgagaaaagagaaagcacaaaacattgctgtagcaatggctgccgccggagggatagtgcggaacacgaagagaatggcggagcgcttattgacaagaggataactgaaagcaacgccaccaacgccgacagaaaagtagatggattgctggaaataatcgtcagtaatgaaaacttaaaccgtgcataccaacgagtgaaacggaataagggagcaggcggagtcgatggaatggaagtaaatgaacttttacagtatctaaaagacaatggcgataaaataaggaaatccatactggcaggaacctatcagccagccccggtaaggagggtagagatacccaaagaaaacgggaagaaaagaaaactgggaataccaacagcagtagaccgtgtcattcaacaggcaattgcccagatattaacgcccatatatgaagagaaatttgtggaaacgagttacggattcagaccgggaaagagtgcccatgatgccctgttaaagtgccagacatatctggaagaagggtatatttggacggtagatatggacctggaaaagtttttcgatactgtgaaccagagcaaacttatacaagtcctgtcaagggatatcaaagatggaagggtgatatccctgatccataaatatctaaaggcaggagcagtatggtgtgaaaagttcgaggaaacaggaatcggtgtaccacagggaggaccgcttagtcctctttgtggaaatatcatgctaaatgaactggaccaggaactaaggaatagagggcaccgtttcgtccgctatgcggacgatatggtgatattttgcaaaagtaaagcaagtgcaaagcagacacttacccatatcataccgtatatagagaagaagttgttcttaaaagtgaaccgggaaaagacgattgtatcatatgcagggaaaataaaatttctggggtatggtttctataagagtcgtttgggctttcgaatgagagtacatgggaagagcaaagaaaagatgaaggcaaaggtcaaggaactcacaagtaggagaaatatccaaagctatgaagagtggaaaagaaaaatgaaacaattcatagtgggatggataaactactacaagctggcagatatggaaaatctgttaaaagagacggacgaatggatgaggagacgaatccgaatggtattctggaagtgttggaaaagagtgaaaacgaggtatcgaaaccttgagagccttggaatcagcaaaaccaatgcaggaatccttgcaaatacaaggaaaggctactggcgtacagccagcagcccaattctaaaagcagccctgacgaatcaaaggatagaaaaggacggctttcagtttttcaattcttactacaaatctgtgatagcgtaaactagggaaacgcccagtaccgaacggtatgctgggtgttgtgagaggtcggctgactaactaatggtcagcctcctactcgattttgattaggtgttagaataaggataaatgattgcacacatgctcaaagcaggaattgggattgccgatgatttatattcgtggaggttaagtttatggatgactttacagaaaaagatatggaggaagcactccaggcaataacttcaatgatcagcaggactgagaaagcaaaagagaaatttgcgcagggtacttctcagcatacgttacaaaagaacaggcttaaagcgcttcatatagcttcatcactgatatcaaagggcctggcagagagtgatgctgtggattgttataccgaagaagacttgaaaaatgctcttgcaccaatcacttctctgattagcaaatctgaaaaggcaaaagaaaaattaacgcaagacacttggcagcatttgatgcttagtaataatctcaaagcgctctatatcgctttgccattgttaacgaaggcattgagggagtggccgcatgtttctgagtaatctcaaatatacttttccttctagcttcaaaaaagacatgctttccgccaagttcatgatatcatagggtacagttaaagcaaatgctaaaaaatattattttaaagcgaaaacgtaaacaggataccgggcatgatgtggtatcctgttttatgtatttcgattttggtgccatcctgccggctattttagaattggcttggaagttacatagcgtgactgatagtggctgtaaccaatataagtaaataatgcaatgtacaaaatagaaatgagcatagtcattggaatagaatagggacttgcaacgcgtccggaaatggcagccaaatgatagcttgggaaaaaataagcaacagcagggaagcggtcgctgtgaataaaaacggcagcttcaatcggttccattaaaatatatagtaagcctaaaacaattatcatggactttcctttcataaatgtagaaatcatggtaaaagctgctgtatacgaaagcagcaataatgtttgggctgcaaacattatgaagtaatccggcagacttatttttccaaagccgaaaataaaggacagacccacagtatttacaaaaagtcccaataatacatatgtcaacaatccttttgtatttgaaaaaagcatggataaataggattctttaccgccatttttggctgttgcccctgccaataccgccgcacaaatggtaatcagttcagctgacgaagctatggtgtatactgcatttgaaccatttggaataaatccatacacggattgaacattgagcttatgcccctcgataagcggtgccgtatcaagataggaaattgccccaatggtagccaatgcgtatacaactattatgcaatagattggcaggtttgtatttctcatttttgtatctccgccgggaaggataccattggcaaacagaccgtaaaaggccattaaaaccccacacaaaactgctcccggtatggtgaaagtaaagtggatgcgctcaaaaaagagcttaatcgtatcatcttcaaatatcattctgattgccatgtaagttaaatatccggcacataggtcgtttagaattggaaattgttctatcaactccgacattgaatcgctgaatagaagcaaaataaaagccccgaatataagtccggcaagagcgacaactatttttttcgagtctaacatagttccatctgtggaaataatgctggatatggcaatggcgtcatctaagctcatactgataacagcaactgaaatagaaattacggcttcaaaaaagctgtccttttctttgttctctgattgcagctttctatcaaagttctgtttgctatgaagcagcatattaaacgtgatgtagagcaataatgctcctccgacaatacggatatgcagccatggtatagcaaatagagcgcctgcaatagcaatgaaagtcaacttaaacaccaatgataaaccaacaccaattcgatgaactttctttgccatgcccggcagcagcccattggtagctaatgcgaatacgccgacattttcacatgaaattaccagattgataagtaaaacctgtatgataaagttcaatttgtgccttcctttcccgtatttatgtccgtatctaattattatcagtagtataaaaacatattgtcacgtacctgacaatatgcttttcttatgtcctgactttgtaatattttttagcagatgtacagggaaaggcttctgattggttccagaaaagttaaaaatattaagtcaggtacttgacattaaaacggtcaggtgttacactgattaaaaagtcaggtacttgacatatgaaaataataggaatgatagcaggaggacttaacagtggatgaaattaaaggcacgatcaacggacaactgcagcagcttcaaatgctcatgcaccgcgcaatgtttaaccattttggcaaaatgcacaaccctcacagggggcaaggccgggtgctggcaattctcaaattgaaacccgtaatcagtcaaaaggaattgacctatttgctcaatatgagcaaacaatcagttgcagagctggttgcaaagctggaaaaatacggctatataacccgcgaaccgtcagaggacgataagcgggttatgactatccggctgaccgaaaaaggcgcgaatgccgccggcagtacggacgagagcgagccggacgttttgaaagtccttgactgtctgaatgatgatgaactgactgattttagtaaatacctggggcgaatcatcgggcagtatgaggagcaatttcctgacgaggatttcgaggagaggcgtaagtatatggagaaattcatgtcgtcttacggacacggttatgaacattggcagcacgccggttatggatttggtgggcatggacatggacactgccagactggaacaagacattcaatgttcaaaaaaggagggattggacatgacgaggacgacaagtgaaaatccgcccatgtgcagtaaggataattggtctgtgtcaaccgggataagggccattttaccggacattatggttaattatatctgggaaattgcgttatggggtgattggagaaacgaagaaaaacagtcattcgtacttgaagccgggaaactaagcggacgggacatacaggacatataccatgtttgcaatggcggcaattcaatggataagcgtcgggtatacggtgtagaccctgtaaactgcaaattgcaggtagttaattatcagggcagctatcaaatgcaattttatatgagccaatgaaaagccgtgagtctgccgaaacctacttaaaagccatttttctattgcggcagaaacttggcaatgtccgttctattgacgttgcaaatgaccttggcatatcaaaaccgagtgtcagcgttgctgtgaaaaaacttagtaatgagggattactcacaatggatcgtgaccgtaatctcattctgactgaggacggacttaaatatgctgcttctatatttgaacgccatgtagtaattgaaaactttctgaaggatattctcggcgttggggaagaaaacgcacataaagatgcctgccgtttggaacatatagtaagcccggaaacattcagcaaaatcaaagaggtttacggagaaaaaacaaagtcagatcgttaatgtttttataaaaacctcatcaacaaggggaacgaaaaacattgttgtaattgctgaagggttacacttaaaggagtagaaggtggttttgaaaattgaaaccgctgtctttccttttactctgtcatggaacaggttttcgtttgcacctcggattttcactgattgtttaagaaacagcatcaaaataataaagaaaaaacatgtaacggcagatgatccttgtattgttaagagacgggattatctgccattattctgttatatatactcttaaaagtgaaatacaattggaatcggaaccttgatgaacgccagatttccggatgaaagtttaagcagactgatactggaaatattattcaatcaggtcatttttgcaccgtttatctgaatgggcagttttacacatgtggcagcctatggtgtttatgaatgataaaagcttgttggaaaaaagaaggaaattgttcgaaacatgtttcttaaacataaattattgtaagtattgtcaatagcagaaaatgaacttgacgtattaaaatagttatacattatagaaagcgctttcttaatcaaaatacatgaaatagcaggaggataagaactgaaatatatcaaaaataaatcaatagtatcaaaataaaggcgtatatttcactgcattttacttcgtacagaaagcgttgtaaatgaaggagatattggaatatggctacaatatacgatgtttcaagagaatcaggtttttccgtttctacggtttccaaggtgataaacaattacaaaggtgtcaataaagagaccagtgcccttgtaaagcaaaccataaaggaactgggatttgtaccaaataatacggcaagaacactggcgacccagaaatcctggctgatcgggatcgtttttgcagaggaacagggaatggggatcatgcatccccattacagcggcattcttcagggatttaaaatggtggcaggaggttatggctatgacattgtttttatcaacaatttcctgggagaaaaaaagatatcttttctggaacactgcaaataccggaatgtagacggagtcttgctggcgttaaataacagcttcttagagcagtttaaggatttgctggatgctcccctgccaaaagtatcggtggagggaatatttccgggggttccgtctgtcatttctgataatgccatggccgccaatcagagcttaaagcatctttatatgctggggcacagaaagatagcgattctggctggccctcaggatacggtttccggaagcgaaaggtttaaggaatacaggcggttcataagagaaaacaatctggaatggaatcccaagtactgcgtggaagcatccaagtattcaagagaagccggattggaagcggtgaatatcctttttcagcaatgctgggatgaatttcctactgccatttatgccacgtatgatgagtatgccagtggggccatagagatcctgaggaagaggggatttcggattccggaagatgtatctgtgatcggaaatgacgatttgccggtagcttcctatgtttcaccgggaattacgacgattcgccaggacagggagcagatcggagcacaggcagcaaggctgctggtggaaataatggaaaagaaaacagggagtacggagacaataagaattccaacaaaattgattgtaagggaaagcacgttccggatgccgtaaaagaactgagaaagcctgttttaagacgaaacagaaaaaagataggaacagacgactatgactttaattcataatcctattttaagaggatttaatcctgacccttctattttgcgggttggacaggattattacattgccacttctacatttgagtggtttccgggagtaaggctttatcattcgaccgatctggtgaactgggacctcatcggatatccccttgattcaacagaaaaaatcaatatgctgggggaagataattcctgcggggtctgggccccgtgtctgtcctacagtgaagggatcttttatctggtgtataccgatgtgaagtcctatcggggcagttttaaggatacccataattatctgattacggctgaagacatctgcggaccatggagcgaaccggtttatataaactccagcggctttgatccgtcgctgttccatgacgaaaacggaaaaaaatactttttaaacatgcagatggattaccgctcttatcattccaaattcggtggaattgttcttcaggaatacgattgcagtaagaaaaagctggttggagagcagaaactgatttttaaaggctctcacatcggatatgcagaaggcccccatctgtaccaaagaaacgggtactattatctgatcacagcagaaggtatgacaggctttgaccatgcagtcacagcagcgaggagccggacgatttcagggccttatgagactgctcccaatacgccgcttcttacgacgcgccatctgccggagtgcggactgcagaaagcaggacatgccagccttgtaagcacgccggatggagaatggtatctggcacacttatgcagcaggccggccggcgaagacagacggtgcatactgggaagagaaacagggctgcagcgggtgatatggcgcaatgactggctgtatatggagaacggaaccataggaccggatatggtgctccagataggaatgggagaaaaagaaattccggttgatcctgtggagctgtttgaggattttaacggcagcacatgggacaaaaatctgcagacactgagagtccccctgggagaaagaggggatttaaaagcaagagaaggctggctgaggctgtatggggcagaatccttaaattcaaaatacaggcagtctctgctggcccaccggcagcaggaattttatgtggaagcagttacaaaagttgattttgaacctcagaacttccagcaaatggccggactgacgtatttttataatacggactgctactattacctgtatctttccagagatgaatatgagggaaagacactttccattcttcaatgtgatttgggaagagggagccatcccataggaatgggagtttccatcccggagaatagggagctgtatctccgcctgaagacatcaaaggaaaaagcacagttttcctattcctttgatggagagacttatttaaatatcggagatgccatggatgccacaaagctttccgatgattattttcaaagtaccggtcatgttatgtttacaggagcttttattggcatatgctgtcaggatttatccggtatgggagggtatgcggatttcgatttcttttcttacaaggaagaataggttttgggagggatattaatgaagggattcgagtatgtctggaaaaagaagtggtcttatctgatgctgctttttcctgtgctgtattatatcatttttaagtacattcccatgggaggcctggtaatggcttttcaggactacaatatcttccgtggggtgtttgacagcaaatttgtgggtttttcggtatttgaaaagattttcagggacaagcagttttggaatgttgtcagaaacactcttatgctgaatctgctcaccctggcaatgaattttcctcttaccataggcttggcgctgctgctcaatgaggttaccaatgcccgtttcaaaaagctgtcacagtctctgctgtatttgcctcactttatctcctgggtggttgtagcgggaatcgcaatgaaccttttttcagttacatcaggaacttttaatcacatgatcaaggcggcaggaggaaatcctgttccgtttttaagcagtaacggctggtggatatttacctatgtaatctgcaatgtgtggaaagaaatcggctgggggacggtgatctatctggcggcactgaccggagtggatgaaagtctttatgaggctgcttatctggatggggcttccaagctaaaacggattatacatattaccattccaatgatcaagcctgtgatcattaccatgctgattctgtcagtgagcaaaatgatgtccattggactggatgcgcctctgcttctcggcaatacaaaggtcatgggggtatctgaggtgatcagtacttatatctacaggatcggtattgaaaaagcacagtattcccagtcaacagcggtcggactgttccagtcggttgtcaatatcattgttttgcttgcagctgataagtttgcaaagaagatcggggaagaagggatcatatagccgaatgaaaagaacaggaggatatggaaatatgaagggggatacctacgggaaaaagaaagggataaagatcggaacggcggcactttacggggtactgacagttacggtgatcgcctgcatctatccttttttaaatgtattggcttactctttgagcggaaatgcgcctgtactgtcaggaagagtgacattttaccccatagattttactttaaatgcatataaagaaattctggtaaagcagacacagatctggagcgcgatgtatgtttccgtcatcgtaaccattctgggaagcggactcggactgtttttaaccgtggcggcagcctatgtattatctgatcccaccttaaagggagggaaattcttaaccggtatcatcctctttaccatgtattttaacggaggaattatacctacctttttggtagtgaagggaattgggctctatgacagcattgccggtctggtgatcccgtccgccatgaatgtatttaactttattgtcatgagaacctttttccggggaatgtccaaggaattaaaggaggcagcctatattgacggcgcaagtgagatgcaggtattgttccgcattgtcctgcctttgtctgcccccattattgcaaccatcggactgttttatgcagtttcctactggaatgattatttcagtgccctgctgtatattcagacgccgaataaatatacgttgcagctgcggctcagacagcttttgtttgcaggacaattgagccaggtatctgcttcatcggacaatctggggactgccgttatggcggagtccttaaagatggccagtgtcatagtttcaaccgttccgatcattctggtatatccatggctgcagaaatattttgtaaagggtgttatggtcggttcggtaaaagggtgatttgtttcaaaagtgtatgaaataaaataaactataaaatgggaggaaatgcaaatgaaaggaaaatcagcaatttgtctggcagctgtaatgctgctgagcggctgcagcggaactggaggcagcagtcagccgggacagacagcagcagaatctgctgcatcagaaactggttatgttaccacttacggagagaaaacatttgataatgtgacgattacagtggagctttttgaccggagcacggcaccggcaggctctaccattacggaaaaccgatggacaaattatataaaagaagaaatgaataaggtgggcattaacgtagagtttgttgcggttcccagaaatgaagaaaccacaaagattcagaccatgatggccagcggcacggcgccggacattattatgacttatgaccccaccctggcagaaagctattacgttcagggtggtacctatgatttaagtccttatattgacggagacggtcaggcgaaaaatttaaaggcatatgtgacggatcaggtacttgatctgggcagaaatacggaaggcggattatgggcaattcctgccagacgttccattaccgcacgtcagaatgtgtttatccggaaggactggctgaacaagctgggaatggagattccgaccacaacggatgaactgtacaacgtattaaaggcttttaaaaataataatccggatggaagaacggatgtggttccgttttattctacctacatgaagtccgactggacaacatggctgtcgtcagcgttcatgcagacgctgggagatgaggcggcggcaggtgtttcctataagatgtcagcctacttagatccgggatataaggactatctgcaatttatgaataaattatataacgaaggtcttctggaccctgaattttataccagtaccgatcaggatggaactctgaaggaaaaattcgtaaatgggcagctgggaatcggagaatacagtgcaaacggaaatgtggacgccttaagaggagggcttttgcagaatctaaaggccctggagccagaggctgatatggtttccattccgcctttaaagaatgtgaatgacgggaaacagtataatcctcagtattccctgtgcggagcctataacattgttccgaaaacctgcaaaaatccggaagcagtggtgacctatctggattggctgagtaccaaagaaggcggctttgccatcttccatggatttgagggcgagcattacaacttagaagacggggtacccgtggtcatcaattcggattttaatgccgaggataaggactggatccgtcatgacctgttcctggtaggaaatcagggatattacgcttcggaagaagatttcatgaaggccacttcaaaggagattccaggttatgaggagtatgtaatggacaacttcgaaaatgccattgcaggagaccttgtgtatgatcccgcatatacttctcctacccagtcagaaaacagtgcaaagatcctgcttgcagatgacgaatatcttgtaaaatgtatgacttgtgctccagaagattttgataaaacctttgatgcatatatggaagcgctgaaggaagccggagcagaagaggtgaaaacggaaagagaggaatatttccggaataagtgatgtggtacataagtctggttttgaggcggattgctttccgcctcaagaccaaaagctggcggagaggaaggatagaatatgattcaagtagcggtcataggtttgggaaatatatcgggcaatcatttgaacgggcttctggcctttcaggaacggtgcagaattgtcgccctttgtgatatttatccggaaaaggcacaggcggcaaaagaacgcttcggccttacagaggcaaggatatttgccgatcataaggagatgctggattacggactggaaattgatttggtccatgtgtgtacacccccatccagtcatggggaaattgccataaactgcatgaatgccggaaaaaacgtattggtagaaaagcccatggctcccagcctgaaggaatgcgatgaaatgattgaagcggaacggcggaatggagtggtcatggcctgtattgcacagaaccgcttccggaatatcatctggaagctgaaaaagctggcagacagcggtctggcaggaaagatccgctgcgcccacattgattctctctggtggagaggccattgctattatgatttatggtggcgtggaacctggaaaaaggaaggcggcggtcctactcttaatcatgccgtacatcagatcgacatgctgaactggattcagggatctcttccttcggaagtatcctccatgctcgccaatgtgatgcatgacaattcagaggtagaagatctgtcctttgcggcgcttcggtatgaagatggatctgtggcagaggtgaccagctctgttgtgcatcacggcggagagcagggaattatgcttcagtgcgagtatgcaaaaatagctgccccctggtcctgtgcggctgaaattacacaggaaaacggatttccgttaccggaaaagaatacggagcttatggaaaagctggaacaggcttatggagaaataaaagatctggaatatgaaggccataccggagaaatcgatgatgttctcagcgcccttgagcacggaaaccggccgttgatcaccgggcttgatggaaggaagaccgtggaactgattaccgcgatctataaggccggatttgagaaacggacggtgtccttacccatcacaacggatgatgaatactatacggcagatggaattggcaggcatgccatccatttttatgaaaaggcagcgagtgtagaaaattttgcggcggcggatatatccgtcgggaattatggggagaaaaagaaatgacggtaaatcaaaaagacggaatgaactatgcccccaaaggaaaaccggccccggttgtgaaaccgggggaatttatcataggggcagtgggtctggaccacggacatatttatggaatgaccaacggactgttggaagccggtgcaacattaaaatgggtgtatgatccggatccggaaaaggtgaaaaaatttttggagacctaccgggaagaaggtgttatggcggctgaaagtgaaaatcagatactttcagacccggagatcagcctggtggcgtcggcatgcatcacctcagagcgcgcagctctgggagtaagggtcatggaagccggaaaggactgctttgtggataaggcgcctctgacaactctggagcagctggagatgataaaggccgcagtaaagaggaccggcagaaaatatatggtgagctacagtgaacggctgcatgtggaaagtgccgtgtatgcaggggaactgatccgggcaggtgcaatcggtaaggttattcaggtactgggactgggccctcacagattaaatgctgcttccaggccggattggttttttgaaaaagaaaaatatggaggcatcctgtgcgatatcggaagccatcagattgaacagtttttgtattatacaggtgccagggacgcaacagtggtaaacagtgagatcggaaattacaatcacccggaatacccggagctggatgatttcggtgacgccaccctggtaggtgacaacggagccatgggatacttccgtgtggactggtttacgccggacggcttgtctgtctggggagacggaaggacctttgtcctgggaacggaaggatatattgagcttaggaagtatgtggatatggaaagggaaggcgccggtgattttgtgctctgggcggataaggagggagagcattccgtcaatgtccggggccgtgtaggttttccgttttttggtcagttgatcctggactgcatcaaccgtacggaacatgccatgacccaggaacatgccttaaaagcggcggagctgtgcgtaaaggcacagatgctggccagaaaagtaaaatgagaggatgaatcgcatatgcttagaatcgggattgcagggcttggtgtcatatcggaagttcacaggaaggtgattggctctctgcagggcgaagcagaagtaactgcagtctgcgactgtgatatccggaaaaaggagaaagccctggaaactgtattttatacggatctggcacagatgcttaaaaatgaaagccttgactgcctgcatatctgtctgcctcaccacctgcatgtgcctgcggcaaagctggctgcatctatgggagtttcagttttcatggaaaaaccggctggcttgaatacagaggatatagacgccctgcttcagaatgaggaccttaaccacattcatcttggcgtgtgttttcagcaccgctatgatgcttctgtccagaaaatgctcaaaattctggaagaaggaagctatgggaagcttttgggctgtaaagccgcggtcacatggaaccggaccggggattattataacagagatccctggagaggaaaaaaggcagaagccggaggcggagtcatgttaagccaggcggttcataccatggatttaatggagttgttttgcggaaagcctgtctggacaaaaggaatggcaggaaaccttcttctggaggatattgaggtagaggatacggcatgcagctttacgatgtttgaaaaagatgttcatggagtattctacggcacggttacccattgcaggaattccagtgctgaacttgaggtcacaacggaaaaaggaaccttttttttaagaaacgacaaattgactgtgttgaaggatgggcaggaaagcgttttggcagaggaccatgcagaaggtggaggaaaggattattacgggtacagccattcccgtgccatccgggaattttatcatatgctggcaggcagcggagggtcttgcatcagtcttagggaagccagaaaggtcagcgtcctgatcgacaagatccaggaatctgcaaagactggaaaacgggtttattttgatctgtaaacaaaaaccaatatttgatgaggctttgaatatgaaacagaaaagtgaaagagaacgcagactgtgggctcaatttgatgcactgcagctgggaagcggctgggcagaggaagatattgaaaagccccagatcctgattgaagatgtatatggggattcccatccgggaagtgtccatttaaaccgtctgtcagatcaggtgaaatggggtgtgctgtcagccggaggatatggcgcacagtatcacgtgacagatatttgtgacggctgtgcacagggccatgacggaatgaatctggtactggcatcaagagaagccatctgcgatatggtggaggttcatgccggtgctgtgccttgggatgggatggttctttccagctcctgtgataaatcggttccggcccatttaaaagcagcggccagaatggatattccaacggtttttctgccgggaggaagcatgaggccggggccttatatgactacttctctggtggccggagatatatccctaagggaaaaaagaaagaatgaaataacaaaggaggagatccgggaatataaattgaccggctgtccttctgcgggggcatgtacctttttgggaacggcttccaccatgcaatgtatggcagaagctttgggaatggctcttcccggcagtgccctggttccggccaccatgcgggatatttcggaatacgcaaggcgggcgggaaaagcggtcatgaatctggcccggattgatttaaagccgtcccagattatgaccagagaggcgtttcaaaatgcaatcatcctgcatagtgccatcggcggttctaccaatgccaccctgcatttgccctccattgcatcggaactgggaatggagctgcctatggaatggtttgatgaaatcaatcacgaaatccctcatttatgcaatcttacacccagcggaactcaattgacggaaagcttctggtttgcaggcggaatcccaatggttcagatgctgttaaagaattatttgaacctggatgttatgactgtgaccggaaaaacccttggagaaaatctggaggatatccgtaaagaaggctttttcgaacggaatctgggatatttacataattacggattgaaacggcaggatgtcattcaggaaccggaagatgcagaagaaaaaggttccattgcaatcctgaaagggaacttagctcccgaaggatcggtcattaaatattctgcctgtgcaggagaactgcgctcccacacaggaacagcaaaagtgtttgactgtgaggaagatgctttttctgcggttgtcagtcatgaaatagagcagggagatattcttgtgatccgttacgaggggcccagaggaagcggtatgccggagatgcttatgacaacggaagccattgtttgtgataaggacttaaacggtaaggtttctcttgtgacagatggaagattttccggtgcgacgagaggtgcagccatcggccacgtgtctccggaggctgccaggggcggaccgttggcttttataaggtcaggagacttaattcattatgatgtggaaaaaagaattctggatatcgtagggatcgccggagaaaaaatgacaccggaaaaaattgctgaggaaatggaacggagaaaatcagaagaagatcccaaactgcccgcaggaagaaaagggctttttggcaggtataccaggcatgcactgtctgcgatgcaaggggcaggttattagggaaggaagaatatgaagaaagcaaattattatacacctgttgttactgtctttgatgaaacagaaaagccggacagcaacggaaaccggaaaatctgggaacacctgataagcggcggcgtcagcggtctggtcattatgggaagcattggggaattttttgctcttgattatgaggaaaagcgccgtctgatatgtgatgtgacggactatgcaaaaggaaggaccaggcttttaattggaaccggaggcatgaatgcggaggaaacagttttactttccaactatgcgctgtcaaagggagcggatgcagtgctggtaataagtccgtactatttttccctgtctgaaagggaaatacatcattattatgacacggtatgcggtaaaatcaaggggaaggtttatctgtataattttcctgccaggaccggctatgacataagtccccaaaccacccttgagcttctgcgcagccatggaaatattgtaggttataaggacactgtgggggaaatgggacatacccgtgccctgatccagacagtgtcacaagaatttcctgattttgagatattctctggttttgacgaattcatgcttcataatatgctctcaggaggaagcggctgcataggcggattatccaatatttatccggaattggcttcggcctgggtccgggtagtggatgaaagaaaccttgaggcttgtgaaaacattcagggaatttttgaccagcttatggaaatttattctgtggcagagatctttgtgccggtcataaaggaaggagtcaggaacaggggaattgagataagtattaagtgcaggaatcctttgacacctttgacggaaaaacagaaaaagcatttgtcaacaattatggcggcttgcgaagaccggatgaggaaatgccatattttgtgatatggaatcaggaacttaggttgtgccagggaagcagggggtgaaagaaggaatggatgcagtgaaaggaaacatggatttatttctgtttatgggtcagtctaatatggcaggcagggggattccggatggaaaaaccggagagcaagctccggtaattttgcctggtgccggctatgaataccgtgccgtgactgcgccggaccgcctttttttaatggaagagccttttgggaaggaagaaaaccgggaaggcgggatcgatgatggggataaaaagaccggctccctggcggctgcctttatcaatgcctattacctttgtacgagaattccggttgttgcaatttcagcctccaagggaggttcctccattctggagtggcaggcaggaggagaatttcttgaagatgcgaaggagcgtttgcggtctggcaggaagtatttggtggaacaaggcttttgtattcgccatatttatatgctttggtgccagggagaaaccgatggagaccgggggttggagcctgaggaataccggttatattttgagaggatgctgggggaaatgaaggagacaggcacggaaaagtgctttctgatccggattggagaatataacggagaggaagcggtaaattatgataagataataaaagtgcagacccagattcccaaggaacatcccgatgtggttttggtttccaccgattttacagaaatgaaaaagcgaggcggaatgaaagactggtatcattattatcagtgggcatacaatgaggcagggttaaaggccgggatgaatgccggtatttttgttaataccggcagggaaccggtcttgtatgatcctcactataaaaatatatattttagtaatcaagatgcggtcaactaaaggaaccggtattgtggaaaatatttgatatgtattacaaagattatcataaaatttagtccaattgcataaaaagcagcacaggacaatttccattagaataaactgaactgagaatgaaaatgcgttaatttcaagcagtttgcaggagtttatatggacaatatcagttatagtgatgaagcaatggcaagtgcaggattaccttatgataatataaactggtatagtattgcgggccagccttttggtactgcctccaaatttaatgttattatttttaacgatgccaataacattgttgatgttgaaggacctgtagcaataggcggaagtttttacagcccaagaggattgagtgttggatttgtcagaagaggtaacaaggaagtcagttactcaccggatttagtacgctttttagttggcggtaatgtatctatgaccggccctttggttgtgatcggccatgtggttgtgggaggcggattccgtgcagccaagggaagtacgtatttaattggaaaaggtggtataaatgatgggatacaagaactgaaatttttataccaggccaatggaggcagccaatattggacaccatcggataagggtgatcactatgtggttcccagttatgatgtaccaagatatatacctgcaagcaggataggcgccgatttacccagatttttcaatgatgccagggaaaacatcggatactacaaagactgtattgaagcattaactccaaatggagttgttgtggataataatttcgagtggattttaagaggcaatgaccctgtacaaaatgtattccttattgatgtaaggccaaatggtttaatcaacaaaggaatacgtgcagaggttccacaaggaagcagggttattgtaaggctgagaacgggagcaaatgctcatttgcaatacggtgtttacggggaaagaagtaaggcaaatcagacattgtatttgtttgaggatgcatccaatatttatatggaaaagtcctccgatatctggggaagtatactggcaccacaggcaatgttccatgcacattctacaggcggccatgtaagcggtaatgctgctttaggctcgtttgcagtaaatgctgaaagcggctttgaatttcattatttcccctttgttggaggagtggaatgtcagggcatagcaccagcccctgtggttcccactccggaagtacctcaggtattgccggaaagtgaggaacagcctgctcaggtgtgcccggaatgcccggtgtgtccggctccgacaatttgtccaccacaggaaccctgcccgacgtgtccggtgccgcaaccttgtccgctgcctgaaccatgcccgataccggaaccctgtccgacgtgcccggcgccgccgccatgtccggaaccggaaccctgcccgacgtgtccgacgtgtccgacgtgcccgacgtgcccgacctgcccggcgtgcccggcaccactgccatgtccggaaccggaaccctgcccggtgtgtccgccgccaacgccttgtcctccctgcccggtgtgtccggtgtgtccggaaccaacgccttgtcctccctgcccggtgtgtccggaaccaacaccttgcccggcctgtccggtgtgtccggaatgcccggcgccagaaccttgcccaccttgtccggagccggaaacgatatttattcccgttccaatacccgtacctgcagagtgcccggaacccgaaccctgtcctgtttgtgaggaatgcctgattaaaccctgtattattatggggtgtatttggggctgccggtgcgataatttccatgattgggatgtgaaattatatgagagatgcaacggcatagacacgtttctgtgctgtttacagattaacggttgtggctgctttaaattcacagttccttttgaaggcctgtatgttttaaaagtaaggctgtctgatagctgcagcaagacataccggtgcaaaccagtcattacttttagtaatattggtgttgaatgttttatgattgaataatttcatatcaatttgccgtgtgttattatttttctggactgctgcaagcgggtcataccttattgcagcagtttttttattacaaaagaatatggttgattctaaggaggaccgttggcagcacgctgaggcagtgatgctgattattcattcttgacagaatatggaaaagggagtaatgttatatatgtctaaacgacatatataaaccatgattttataaaggagcaatctcatgatagagttgattatcttaggatttttatcctataatcattcactcactttatatgacataaaaaagggaatggaaagaagcactgaatattttgcaagtacaagtcaaggcgcaatccatccaactttagtgaaacttgagaagaatgaatatgtaacttcaaaagaagaagttaagaataacaggacaaaaaaattatatagaattacagagaatggaagagaacgatttagtatgttaatgagacatgatctgggtcctgataagtataaatccacacaattgctaaagatgtttttcttcaatgagttaaccaaagatgaacggctggaatccattaacacccatattaagaactttagagatatgcagcgagacctggtaaacatcagagatgaaggaaaactgcagcttgagaaactagggctttctttagaagactgtaagccagccaaatatgaaaatgatgctcttgagtttggtcttgcatattccggctttgttataaagtggtttgaggattatttcataaggattgaggaggagtcatgaagatatcgatttttgatttagggaaaaacacaagaaaagaatcactggctcaggaaattaagaattattatacggaaaagaataaagacgctgaagtgattatctatcattctattgataccgaaataaaggattgtataggctgctggagctgctggtggaagagtcctggaaaatgtgctttaaatgatgatgcctataaattgtataaggactatataaacagtgatgaagtggtcattctttttcatacagaaaatggctttattgacggcaagggaaaaacatttttggaccgtttaatacagcattatttaccctacattaaaataagaaacggtgaatgcggtcacctgaaaagatatcataaatatccagtaatgaacttctatttagaaaaaagcgggttgagtgatgaggaagtaaaagtcataaagaaccatcttgcccggacagcataccatttccatagtgcttgtaaagaacttctgtatgaaaacgaaagcgtacagacaatgaacttagaatgtacaaaacctatggccgaggttctggcaaaggaagttgttggaagaaaaaccagcggtaaatgggtgatttataatggctctccaagaggaaatcattctaacagcaagcggatcattgaaaagataattacagggatgaaagaacagggagcagaaaatatagaggtaaggaatctgataaatgtaaaagaacataaaatatgggctgaggatttcagttctgcagaaaataatttatttgtttttccgctttatgttcatgccatgcctggctcagtaatgaaattctttgaacagctaaaaccaataaacaataaagaagtacatatggcatttttagttcagtccggttttccggagaccagccagtcgtactatttgagaccttatcttgaacttattacaaaaaggctgggggtatcctttgatggaaccattataaaaggcggcgtggaaggcattcaaatgaaaccggaaaaagccaacaaaaagttctatgatcaaatggaggcaataggacgaacctatgcagacaaaggaattatggatttaagcttgaaaaaggaatatgagaagtccgaatacctgtcaaagggtatacaattattattctccctgttttctttaaccggattaacaaactattattgggacttcaatcttaagaaaaatggtgcttatgaaaaaaggtttgcaagaccatatgtggaatgaaagcaagacaaatccacaaagctttaactgcaaccggtgcaaaaatgccagttaaaagctggtgtgaatcatgttacagtaaaaagaaacctggaaaatattaaatataaggagcaattacaatgaatgattttatggatttatgccttcgcaggcaaagctgcagaaattttaaagatcaaccggtagaacatgaaaagctggtcaaatgtgttgaggcggcacacctggcaccatctggctgcaatggtcagccctggagttttgtggtagttgaaaatccggaactcatagaaccggttgcagaatgtgcacagcctctgggaacaaatgggtttgctgccaaagcacgggcattttttgttgtggtcgaagagtacgccaatttaatgcctcatgttaagcgccttgtagacagtcagtattttgctcccggggatattggggcggcaattgcctatctttgcctggaagctgaatcacagggaatcggtacttgcatattgggaatgtatgacagagaaaaggttgcttcgctgctgaatattcccaaggaaaagcatatatgcggattaattgcggccggatatccggcagaccagacggtacggaagaaatcccgtaaaccgctggatgaaattgtccggtttatataaacatatccctgcactaatacaactagatacggcagatccccaatacattttaacggaaatgggagttggatacagattgttagaagaaacaataacagatatctgatgatcatttcatgatcttttctgcatagtttccgtggaaatacaaaaactatcgacagataggaggtatcattatggcaaaagcaggtatgagaagacccagtccttatgattcaaataatcatggaacggagaatcatgagaaaatgcaccgtccaaaaaatgagcaggcccaagtgccggaaatccagggagcagcaaaaaatgggaatgataaagctggcccgatcaatgctccaaactgggccagggacgattacaaaacgggaaataagcatgacggtgtttaacctcatcaaatagcaaagcggagagtccgcccgatggtgctggaagcgctgtgacctttggtcattgcgaatatccgattgaggaaagagggttgcagcttcttagcaaatggctatgaagctgcaaccctcttattataaagtgttcagaccgctatttaggtgggtttacatcgtaccatgaaaggaactgagtaaaatgctcataatcttggagtccgcattttaaccagctgaagaaacctttcctgtgaaggtaaagaattttgaagctctttgtatggaaaccctttgtcaaattcttttgctgcttcttcatcaatttcaaatattgggtcttcaaagaagcggccggaacaattggacaatgaaccttcaattaattcaagagccagtaatggagcagcatacatatgatccggtgtgccgattttgtaagtttctgccccaacaaaaccaaatttactgtagtaggaaggatcaccgtaaatcaaaattgccttgcagcccaattcctttgcaagctgtttggtgtgttcgatgagcaatctacctatcccttgcccttgaaattcgggtaaaaccgaaatgggaccaaagctgataaccggataattgtccccattatcacacagtatggttgcctttgtgtacatgatgtttcccacaatcttttcattttcagcagcaacaatgtccagttcttttataaatgactgtgattcccgcataatgtgcaccaaataatgctcattgcagccggggacatgatgattccaaaacgcttcacgggttaattcttcaacaatcctgtaatccgatgcgttttcctgacgtaatctaatattttccctatgcaagattttctccctccaaactcttatatcatatagcttatcggaacttgcagattccattgcaaaccgttgataagctgtgatttatgattatcataccatagatcacagcttatttccacagtccttatgaaggctgagcaagcggatgaaggggagtttcatcttcgattatgtactggttttatttccttccatctgctgtatgcggttcatgtgctgcctcttccggcttaaaaatgaccggtcttagtccgttaccggagaggcagacctttccgcaaaagcacagcgccagaggtcataataacaaaaaatacaattaaataagcgactgcagccattccgtgggcaaaccaggccgctgtgaccataaagatacaacctgcgagagatacgcagggcataaatatccggttaaaaaagttaagctctttcccctttaccatgaacataataaaaatagggatatatagagcatatattgtaataataggcaattccgaagaatcaaaactgaaaaatccaaaccaattggaggttaagttagccccataaaaataaaataaccagatggcacaaagaaacaaccccataattgcggaattcacaggcatattggtcgccgggtctatttggctgaaaacctggggtttagggccaaggcctcttgcggcaatggaatagattccccgggtgcagccaagcatcagcccgtttaaggtccccaggcatgaaatgatgacgaatacaaataaaagggaaccgcctgctgaggtgaaaaccgtctggaatgccagcttggcgccggattccccaccggccatcatcacctcatttttaattgttccggccagaccgatgtaatacagaatataaacggacatggttataaaagtacccacaatcaaagccaatggaagatttttttttgcatttcttaattccgcgttaatacaggttgcaatgatccagccctcataagcaaaactggctgctacaatagcggtgaatagtccattggaagagctttgggacacgtaatgggtgaaattatacaaggtcatgccgcttcggagtcctgcaaaggtcccaaccactgccattaaaaagagggggatcagtttaatgaccgtagtgcttacctgaaactttccggccaaaacaggagacagggcatttattgtaaagcttgtaacaaggtaaaggcaggcaatggtcatacattctccgcctgtaatggaaaaaccgaaaatcacacaggtgtaccgggcggaaacccatgcaagaactgaggtaattgtgggataataaatcactgccataaaccagccgacataataggcatatgtttttcccattgcggcttctgcataatccaccacaccgttgatatactgatatttggtagccatgacagaaaatgtgtacgcacaggaaatcatgatgataccgccgatcacccatgccaggatgccctcttttaaattgcctcctgttgctgtgaggatcttttccgccttaaaaaatacgccgctgccgatgacgatgcctacaaccattgcaatggctgtaaaaagaccatatttcttttctaatttcggttccatagtttaccagtcctattcttccataggattccttttttgattattctttcaacataaaaaataattgccataaaatcagatttgataacatcgaggcaattatttcttgatgacgaaactttttttattttatcataaagttagacataattcagcaagattttttctttttggaaaaaaaattggtaaatataaatattttccaattcatgcaacaaatgggcaatgggcagatttcatggctcggatttccggtgtaaaagactgttaaccgggattgacagctttgcagaagataaggtatgataaattatcaaacaatgacagcataacttcgcagtaggagaaaacataatcaaagaagagtctgcagccatggatccggtttccgcgacggcggaccaacaaagtgtgtaaacgccggggatcaaaagggtgaaaggagaaaggcattatggcaaaaatcaaggaatttacgctggaaaatatggaggaaatctgcgagttcggtaaggcggtctcatcacctgtccggctggaaatcatcaagcttctgtatcagaacaattattccataagtcagatcgcggaagcccttaatctccctcagtccagcgctgcctttcatttaaagcttcttgaggcggcagacttgatccgcatggaagaacagccggggagccatgggaccatgaaggtatgcagcaggaagcaggactatgccaatctctgctttctccccagaaacagccagatcaatgaggtcctaagccttgaaatgccggtgggtgcatttgttgattgcagtattttccctacctgcggcttgtacgcgccttttggggtagtcggaatggaggataaggaatacagcttttatctgccggagcggatggaggccggtctcttatggacttccaaaggccatgtggaatacaggttccccaatcagcttcctgcaggaaaacagccagtgcgcctgtctttttgtatggagatatgctcggaggcgcctgggtatgcggaggactggaagtccgatatcaccatatgggtaaacggagtagaatgtgctacctggcactgcccgggagatttcgggtccagaagagggcggcttacgccagctttgtggccaaacggttctactcagtacggtcttttggtaaagtgggagatccgggaagatggaagctatattaacggggagcgggcttccaaagtcaggatcagtgatatcgggctttcgcaaaacgcctttattagtatgaccgttggcaataagaaaaatgcaaagtatgagggtggatttaatctttttggaaaggccttcggtgattatgctcaggacattattatggaaatcgaatattgatgatatatgacgaaagtgaaaacagctgtctggagaatatttatattttccgggcggctgttttttctctgtcttccgtgtggagaggagagggcttgtattataacaggaatcttatttttttaaatggaagagataaataataaaacagtagtactgttgtaaatgtaaaaaataaacaaataaatatataaaatatagaataatatattgacttacacaatgaaaaggtgtattgttgatgtattaaatcagtaatactgttgctaattcgactttttacgagccggaaggacaacaggctgttttatggtttatgtggtaaaacaaacaaatcaaggaggtaattatgagaaggggtaaaaaatggatggctgcattaggtgcagcggcactggttatggcagcactgtcaggctgcggaagcagcacagcaacacagacgacagcaggatcccaggcagcgcaggaaactcaggagagcaaggagacttccgggggtgaaactacggcagcggcaacggaagaaacaaagaatgtcaatgacgacggaacggtcaacaatccggagcaggtggcggtagattccaataagctggttatgtggtccctgttcagcggtggtgacggtggtttcatgaacaagatgatcgaagagtataacggcaccagccctaccaagcaggtacagtccattatgctggtatgggcagattattatacaaagcttcagacagccgttgccgcaggaaaagggccggatatcggtatttcccatgcctcctccctgcctcagctggtggaagacggtgtggtacagcccattacttcttaccttgatgaactgggaatcgatttgagccagcattattccaaggcctccattgatgccgtgacctttgatggagaagtctatgcgatacctttagatactcatgcagagatcatgtactttaacaaaggcatattagagcaggccggcgtgaccttaaatgcggagggtgcagttgacattaagaacgtggatgagttctatgccgtttgcgataagatcaaggctgtgatcccggaagacggatcaaccattgcaatcaccaataacggagacgatccttaccgcttatggtgggcaacctatttccagatgggaggaacccctattgtcagcgaagacggcaaggaggtaacccttgataaggaaaaggcagttaaggcggcagaatttgtaaagggtctgtatgataagggctatattaaggaaggaattgatgatcaccagaagttcttccagagcggaaaagcaggaatctgcatcggcggaacctgggcagtaggcgcttttgagcagacggataatttaagctttgttccaatggctttccccaagctttttgatacggataactgctgggctgattctcatacctttattcttcctacaaagaaagcaaggaatgaggctgacagcaaggcagcagtggaatttatggcggctgcatccatgaagggcggagtgacctgggcaagctcaggccagattcccgcatgcaaggaagttcttgcaagtgatgactataaggcgcttccatacagaagcagctatatgtcagaggtagagaaggcagtccttccggcaaaggtatctacttttaacgggatgaagaaagggatgatcgacagcctggataccatctggacaggaaagggagatgctgcctccggtattgatgcgctctatgatgagcttgaatcaaaccttccgtaattttatgaaacagagggggggatccttctcccctcttaatatagaagcattgcatggttggggaggacagtgatttgagcagaagcagaaaaataagagatatggctacaggcctgggattatgccttccctttttggccttatatacggtttttaccatatggccggttatccaggggctgtatgtgagcctgcataagtggtccttaatgggtaaggtaaaatttataggactggataattatattaagtttttttcagatcagaaatttattgacgcattgggacatacggtcttttttgtcatcctgtccgtaccgtttttggtgatcatggccttgatactggcgctgtttgccaacaggccggtgaagatcaggcggggattaagaatcgcgttttatcttcccagcattatatccgtttctgttgcgtcatttattgcaaaatacatgtttgcaccctatatgggctttgtaaacggaattctccatctgaccgggcttttaagcccgggatcagaaatccagtggttgattgacacaaatcacgcatgggcggtaattaccatgatgaccgtatggtggaccgtaggattttccatgcttttatatttatcggctctgcaggacatctctccggagatttatgaggctgcggaaatcgacggagcggcaaaatggcagcagcttttttccattgtcctgccgctgttaaagcccaccacctatttgatcgtcatgctgcagatcattgccagctttaaggtgttcggccagatttacttaattaccgtaggagggccggcaggaagtacaaagcctctgatccagtatatttatgagacagggtttaccaagaacaatatgggctatgctgctgccatgtcctatgtgctgtttgccattctggtggtgtgcacccttattcagaaagcgattcagaggaagggggagaaggaagatgaagcataagaaagtaacgccagggagcgttgttttaacccttctgtccgcagcgcttgccgtcatttttctggcacctgtgttctgggcttttttcgtatccctgcagtatgaaggcaagcagatcaaaagcgtgtccagctggttttctcctccttatacctttggaaattatctggacttaatcatcggttccgatgttgccaagtggctgttcaactctgtgatcgttgcagtactggtaacggttttaactgtcattttttccgccatggcagcctattctctggcaaaaatcaaatttacgggaagaaataagctgtatttctattttttattgggactcatggtcccaggggaagcgaccgttgttccgctgtttataacggccaatgggctgcacctgattgattcttacgcagggctgcttctgccgtctgtggcagtgtccatgaatctgatcatcatggtgacgttttttaaggggattcccgattccctcattgaagctgcaaggatcgacggcgccggagagcttatcatttttgccaggatcatcatgcctttatcaaaggcagtggtttccactatcagcattttcgcatttatcggaagctggaataattatctgtggcctctgctttgcgccatggacagcagtaaatttacattgcctgtgggcatccccatttttgccgggacttacactgtggattatgtgaagcctatgacggccaatatgatcgcatccatacctgccattatcatttatctaatatttgaaaaacagattgtgcagggaatcaccatgtccggcgttaagggctgacttaaggaaaaaaggagaggagaatcattacatgctatgctatcaaaaggactatccaagaccccagtttgtccgtaaggactggaccaatttaaacggaaattgggacttcggttttgatgatgacaataaaggcgaagccgagggctggtatgagggcttccagacggaaagagaaatatgcgtgccctttacctatgaaacgaagaaaagcaatatccatgaccaggaggttcaccattttgtgtggtatagccgcaggtttcaggcgcagaaggagaaattatccggaaataagctgtttctgcattttgagggaagtgatttcctcacaaaggtgtggatcaacgggaagtttgccggcatgcatgagggaggatattcccgtttttcctttgatatcacaaaccttgtaaaagatggggaaaaccttgtgacagtaaaggcggaggatcatatggatccccagcagccaaggggaaagcagcgttgggtttctgagaattttggctgctggtatgttcagacaacagggatatggaagaccgtatggatggagtatgtgccggacatctgcttaagttcggtgaagatgactcctaatttaccagagggcaggcttgagctggaatataccgtggactgtccggctgcccttgacgggagaaggctggaggtggaggcggtcgtaagctttgagggcaggtttatcaccagaaccattaccggtatagggaaaaatcccactaaggtttccattgacttagaggcggctgaagcggagaatccgtggggatacgcacatggaccccggcagctccccagctttatgatatcagcttctgcacccggtacgacggagaggtgtgtgatgaggcaggatcttactttggcatgcgtgagatccgcatcgatggtcccaacattcttctcaatggagcaccgctgtatcaaaggttgatccttgatcagggatattgggaggaaactcatttgacacctcctgatgaggacgcgttgatcgaagatattgataaaatccatgctttgggatataacggtttgaggaagcatcagaagacagaggatgaacggttcctttactggtgcgatgtaaagggaatgctggtctggagcgaggctccggcagcctatatttattccgaccgggcagtggagctttttacaggggaatggctggatattgtgaagcagaattataatcatccttccattattacatggacgcccataaatgaatcctgggggttccgcagattgagacgagcaggaagcagcagcattttacggaaggaatttatcatctgacgaaaagcgttgaccaataccgtccggtgattgtaaatgacggatgggagcatacggtttcagatatcatcacccttcacgattacgaagagaagggggaagtgcttagaaaacgttatacagaatacaaggatgagattatgacggcagaggtttaccactctacctctaaatcggcttttgccaatggcttttcttacaggggccagccggtgatgatcagtgaattcggaggcatcgcatttgacagtgacaaggaaggctggggctacggaaataaggtcaatacaaaggaggactttttaaagaggtttgagagcattaccacagccattaaggagataccctatgtatgcggctattgctatacccaggtcacggatgtgcagcaggaggtcaatggactgatggatatcaggagaaactttaaggtggatccggagaagataaaagaaattaatgaaaagagagttgctttttggaggaatgaactccggtagtacacgtcttttgccagaactggatcaatcataatttttattgtggataattgttaaaaaaacagtcactcccgcaaaaggatatttgcctttttgcaggagtggctgatcttttttattttggtgcgatgattgtgtgaacataagtcagcatttcttctttcgactgtatggtttgagtatgatcgatgatctgctgctgtgcttgagcaggcaaggaaaaaaagtaatccattgccttatattcttcaagtgccaggcctaagcctaccggcaattctgcaccgctggtatatttttccatcgttagccctcttttttattaagatttttatacggccttttatttgattgcagatgctggaaataatcgtcaggatttgtccatcatctgtttttcctgctcttcaatcattttttttaccatgtaaccatattgataagacgtcattttgccataatcattgcttgtgatagggaagccggtttcttcggcaatttcatatttaaacctgtcaagtgcctcccttgcttcgggaattacattgctttttggcatagattcacctcaattcgttttataagatattattatgttttttaggaaaaatattcagaagcttaaatttgtggaagtattcttcaaaacgggacaaacagctggcaaacaggtaacgtttaggtaaacggatacgaagtgaaaagggcaatatcatacaagaatcctgttgtggtttgtggtacactgaatatcagagagtcaggaaaggaggacaagttatgaagaaagagataagaacggtaaaatatgatactgaattgaatgtggaagcttatcattttcaaggcattatgcagaaattccccaatcattttcacgagtattatgtgatcggttttattgaaaaaggctgccggtatttatcttgtaagaacaaggagtataccatagagccgggagatttggtgctgtttaatccgcgtgataatcatacctgcgagcaaattgatggtaaaaccctggattaccgctgtatcaatattcagccggataaaatgagcaaggccgtctttgaaataacaggaaacgaatatctgccttattttacccctcaggtagttttccatagtgaattggcggcagtactcagtgaattgcatcaaatgattatggaggaagaaaaggactttaggaaagaggaaattttctttttccttttggaacagttgattgaagaatatacggatcaggcactgcccgcaggaaaaacggagcaaagtgcacaggcaagggaaatttgccggttcttagaaacccactacatggaaaacatttccctggaagacctttgcagactgaccggattgagcaaatactatctgcttcgttcctttaccaaacaaaaggggatttcaccttacagctatttagaaaccatacggattgacaaagcaaagaaactgctggaacagggcattttgcccattgatgcagcgttacagaccgggtttacggaccaaagccatttttcaaactttttcaaaaaatttatcgggctgacgccaaaacagtatatgaacatttttaaggatatctaaagctgattttttacatagaaagggatttcatggacggaaaaaaagaaattcaaggacacttacttgcatttgtgacaatttttatttggggaacgactttcatatcaaccaaaatactcttaaaagcgatttcacccattgaaatattgtttataagatttgccataggctttgcccttttgctgctgatctgtcctcacaggctcaggatcagggagagaaagcaggaactgtattttgcaggggctggtttatgcggagtaacgctgtattttctgcttgagaatattgcattgacctatacctttgcctccaatgtaggggtcattgtatccattgcgccgtttttcaccgccattcttgctcattattttttggatggagagaaattgagactggggttttttatggggtttgtccttgctgctgccggaatttttattatcagctttaacggaagcagccgcttggagctgaatcctatgggagatatactagctctttcagcagccgtggtatgggcggcctattctgttttgacaaagaaaatcagcgggttccattacaataccattcagacaacaaggcgaattttcttttatgggctgctgtttatgctgccagcattgctgatatttggatttcacccaagcatagatcaactgatacagccggttaatctgtttaatatcctgtttttaggctttggagcatctgccctttgctttgtaacgtggaattctgctgtgaaacaattgggtgcagtgaaaaccagtgtttacatttacgcggttcccgtaataaccgttgtcacttccattcttgtgcttcaggaaagaatcacaggaattgctgtgcttgggattgtgcttacactggcgggattattggtttcccagggcaggagacttttaaagacaagaggagtgttgaagtatgagtgatatgaaatgtgttataattatagattcagaattacctattggcattatggccaacacctcagctattttgggcgtgacgttgggaaaacttatcccagaacaagtcggtgcagatgtaaaagacgcttccggtcaaactcacttaggcatcgtttcaattcctgttacaatgctgggtggggataaagcccttctgaaggacttgcgaagtcgtctgtacggttcggaatttgacgacctggtggttgccgatttttctgatgtagcgcagggctgtaacatatacagcgaatatgctgcaaaagcggctgtcacaacggaacaggatcataagtattttgggattgctatttatgggagcaagaaaaaagtaaacaaactgacaggatccatggcgcttttaagataaaatgcataaccttccttcgcggcaatggatttcgggaaggaaggcttggaaagagctatataataaaccaccagacaagaattgtaagccctgcgccgacaatgcagcagatcatatcattcatggtatccacaagaccggcaggctggattgctttttcagatacatggttaatggaagcatggaccttttgccatcgctgtgcatttccatgaaatatacaatcggttatatattcaagtacctcccaaaacacatgaagtgttatggaaaaggtaaaaccaaagagcaggattaccaattttataatatcagaacctataccggcaattgcaattccaaaacccacaaacccaacgccggacaggaagtgtattgaccgatcccaccatttatatttatcataaaactggaaggagctgcccaggtataatgccataaatatgatgatcagataaacaaggatgctgaaggcatcaacctgtatttgaaatacagcatgtaataattcaggtaagaatgacaacgcaaataccaggataacggatttcattaacttatattcccgtttgtaaatatgataaattgccaacgcaaataaaacacaccgaaatataatctcgcagagacttaaaagcttcatatcatcacctcacgagttgagtatgcacaatggctgaaaaaatatgcgtttattgaaaatacaggccattttgtttattatcctgttcttaccttgctgttgtctgaagatctaaaatcggtagcattaaaaacgaaattccttctcaatcagtttttccgcatattcttctacgtccttctcgatcttcctgtaagtctcaagaacttctttgcctttctcagttaaacgggttcctccccgctcgtttccgcccttttcagaaataacaacaggaaatcccaattcttcttccagggtccggatcatccggatggcctttggataggaaatccccgtgtattccgttgctttttttatggacttattcagttcaatggcatccagcatttcttttacgcctttgccgataaaaattctttctttgccgatccttattcttgtaactacgcgcatcatttgcctcctaatgaataaaacgaatatgcttgcttatcgccttagattactatacaaagatttttaatttgtggcaaggggaatgtgaagcagaaaaaatctacaaatcaaaatttttgttagcttgattttttaaatccgatatattaatatatttatatcgaaaaaaagagaaattcctcctggtttttaattggtttgagcaaaataatcaatatttgttaaaactttatcataaaaaaatttgtgatttataaaaaatcaggagaaaaaaaagaaaggaattatttatcatgcggagaataccaaagaagaaacgcatctatttgtccggattgctcttatgcatcacacttgcattgagcgcctgcaaaggagctggaaccaatgccggttcatcagcacaggagacacagacagtaacggagggcagttctgccggggccggcgagacggcaaaagcagagaaggaatcatcccttgcggcacaaaacgattcagcagtccaggaggtcacggaccactcaggacgtaagctggaactgcctggggccatcagccgcgtatattccaccagccctataggcaccatgctcatgtatacctttgatgacaaaatggtggcaggtgtaaatgtgaacatatctgacggggaaaaggcttatttgacggaatactatgcatcccttcctaatttaggaggctggtacggcaaaggaaaccagggaaacatcgaagaaattattaaagcagctcctgatgtggttctttccagcggaacggatcagggaagcattgaccaggcagaacagctgcagaagcagctgggcataccggtgatattggtgaaaagtgatttgacggatctgccggaaacctaccgctttttaggcaagctttttaacagggaagatcggggagaagaactggcttcctatactcagaaggcattggatgatgcaaaagaaatcacagctcaaattcctgaggataaaaagatacgtgtttattatgcagaagagcaggatggccttcataccgacccttcaggttcctctcattcccagttaattgatttgtgcggcggaatcaatgtagcggattgcgaaattacccctggatacgggcgcactgctgtttccattgagcaggttatgaaatggaatccggagctgatcatctgcagcgttgacaatggatttgcggattccagcagctataacaccatcatgaacgacggaaaatggtcgaccattccggcagttaaaaacggtcttgtgtttgagacaccgatgcagcctcagaactggtttgacaggccgccttctgtcaatacgatcatcggaatcaagtgggttcattccattttgtacccggagtatgtggactttgatattaaggaagaaacaaaagaattttacaagcttttttatcacgtggaactgagcggccaggatgtggaaaatatcacaaagaacgctcttcggaagtgaatcaaatcatgataacaaaggaattattaacaaataacattgctatggttttagaaacctatccctatgccggcgacttttttgcagcctccggcatagatggtttttctgaacagtctcattccagcgtccagcagtatattgactcggttcccgaacatttgctggaggatatcggcgcgtccccctctcagttggcagatcattttatcctgtttttaaaccggatggaatctttaaagcagaaaaagaaatccgtggaaaagatcaccattataggaggacagaacaaattcggagaaagtgaaaacctgtcctttaccattgaaaagggtgaaattattacggttatgggtcctacgggatcaggaaaaagctgcttactggcagatattgagtgccttgcccagggcgatacacagacaaaacggaggatcctgatagatgaccgaatccccagtgaaagggagcgctttcaaatcgaaaacaagctcattgctcagctttcccagaacatgaactttgtcatggatcttcctgtcatggattttttgcgccttcacggggagagccggatgatcgagtcccttgacagcgtgaccgggaaaatctttgatgcagccaatgacctggcaggagaacggttttctaaggaaacacctttaacagagttaagcggaggccagtcccgcgcactgatgatcgcagacactgcctttttaagcacttcccccattgtgctgatcgatgaaatcgaaaatgcgggagtggaccggaaaaaggcgctgctcctgctcgcccaggagcgaaaaatcgtgctcatgtccacccacgacccgatccttgctctaatgggagataagcgcattattattgaaaatggcggcatgaaagccgttctggaaacaagtgaaatggaaaagaagaatttaaaggaactggaagatatggacagaagaacaacaaagctgttacagatgctccgcaggggagagcgggtggagatgtcggtttcaatgctttagtcaggaggttttttgtgataacaggaacaatgaagctaaaggaaatcttaaaacagtatccggaaagttttgaagtgttccggtcaaatggctttgaatatgaagaaccggaggattttttagaagaggttgggccggataccatgttaaagaccttgttatatgtaagaggggtcaatcaggaacttttttataccatctggatcatgccgttttaaaggcagaagcagagcgccagtatctgctggaagatttttcgccgggagagaagctggatttttatggaaataccatatgcccctaaaattcaccttccgtgatgcattggaagatctggagcggaaacacaaagagcactatgggatttcaagaaagtgctacttggaatttgggaaaatgacaaacgatacctgcgaagaatcctgggcagaccctgatccaaagcgttttcccggactgctgttttcaaaagaatttaatgaataccttggcttggattttcaaaagaaaatggccggtatatttgcaggaggctacatccaaaacatgaatcctgcattaaaggcggcaggcctgtgggacccggaggatatttatacggtttacggcgtaatggccgaaatgtttatgatcgataaaaaacggctgggcagccttccggttcccaggactctggaagacttacttgacccggtttatgagaacaacatcattatctttggaaaagaccgggaaaccatatccaatgccatgtttttatacttatataagctgtatggcgaggaagggatccggaaatttgccgggaacgtgaaacacgccctccatggaagtgtgatgtcaaagacagcgggaagcagcaggcaggaaggaggagccatttatctggtttcctggtttttcgcccagacctgcgtgcgggatgaggtggagattatatggcctgatgacggagcaattaccttgcccatgtatatgcttgtgagaaaggatgaggctgagaatgtaaaggatattacggattatatcaccggaaaggacttcgcccaggcttgtgtgaaggcctatacgccgcctatgaacggagaggtggatgcaaagctgccgcctggtgccgcttttcagtggctgggctgggattttatccgtgaacatgatattcctgctttggcggaacactgcctggatgtcttttttcaggagtggcacaggcttcatcccgggggtgtattatgcccatgaaattgattacggtttccgggccgccttctgcgggaaaaacctcagttctgatccggatcatccaacagctgggaaaagaaaaggtgggagtggcaaagtttgactgcttatccagctcggattcagaccggttcggggagcaccagatctcttctgttgtggggctttcgggtaatttatgtccagaccatttttttgtcagcaacattgaagagtgtgcggcctggggctttaaaaatgattttgaataccttgtgatcgaaagcgccgggctgtgcaaccgctgttctcctcatttgcgtgaatttttggcggtatgtgtcattgataatttatcaggcattaatacccctcataaaatcgggcccatgctgcgttatgcagacctgattattattacaaaaggggatattgtatcccaggcggaaagagaggtctttgccttcaaggtaaagatggcaaatcctaaagctgacatattattccttaacggaattacaggacaaggctcttttgatgccgcggaatatttccgcaggggaaaaaaccttctttcggcggatatgcaggattgccgcctccggtttaccatgcctgcggccctttgttcctattgcctgggagagacccgtataggtgaaaactttcaaaaaggaaatattaaaaaaatgaagataggatgatcggaagtggatcaaacaaaaaataaaataccgccggcgcaggtgctttggctgcttgcagttcttctgctggtttccatattagtgtctttgctggcaggacgcttccctatatcgctggcagacgttatgaaggtgctgtcaggttattcggacaatgagcagatctcccatatcatttatcaggtccggctgccgcggatatttgctgccatccaggtagggggagcactggcggtcagcggcgcggcgtatcaggggatgtttaagaatccccttgtgtcacctgacttactgggagcgtcttcgggcgcttcttttggtgctgtgctgggcattgttttgtcggttggcattgttggcaccaagatgatggcatttgcatttggccttctggctgttatgatggcctggtttattgccgcgcggatcggaaaaggcaataacatggtgtttttattggtccttgggggaattttagtcagcggcctgtttcagtcgttgatcaccttgatgaaatacactgcggatacggaaaacaagctgccggaaatcaccttttggctgatggggagcttaaataaagccacttaccaggatgccctgggcatgatggcgcccttttccatatgcattgcggttttggtgttctgcagcaataagatcaatattcttgccctgggtgaggaggaggcaaagtctttgggagtgaatacacggctgcttcaagtgatcatcactgtttcagctaccgttttaacggcgtattccatatcagtgaccgggacaatcggctggatcgggctgatcgttcctcatcttgcaagaatgatgatggggcccaatttcaaatatgtgattccaggctccctgcttttaggggcggtttaccttttgctgatggatgacttgtgccgcagcttaatgaccattgaaattccccttggaatcacaacgtccctggttggaatccctttcctcatatttctgatgagcagaagagaaagcggttggtgaagcaaatgaaaatggaaatgaaagatctcagctgcggctatcatggccatgaggtgattgaacatatcaatatgaccatcaaggcaaaggaaatgtggtgtgttctgggctcaaacggcgtggggaaaaccacgttttttaagacagtccttcgattgctggggcccataaacggcagcatctcattaaatgacattcctctcgaaagctggaaccggaaggagctggcaaagcagatcgcctatgttccacaaaaccatgtcccgccctttgcttttacggttaaggaggtcattgccatgggaaggaatcctcatcagcagggcttgggcaagcttaacggagaagaccggagggcagtggaagaagccatggaactgctggggatcgaatatctttgcaacaaggattatacccggatcagcggaggagagaggcagcttaccctgatcgcgcgggccattgcccagcaaacgcccatattggttttggatgaacctgtttctaatctggatttcggcaaccaggccaggatcatttcccacatctgcggtcttgttgaaaagcttgacaggacagtgatcatgacaacccattttccggatcacgggtttttggcggatgccaatgtgctgctgctttacaaaaataaaaagcactgcgtggggaaggggaaggatattattacggaacaggctgtaaaagaattgtacggtattgagaacaggatcctgtatctggattcctgcaaaaagacggtctgcgtctcactgtgagaaaagggcggagtgacggcagggctgttaagtggctggctgcgtgtctgcaatgcagatgttaaaagctggtattgaccctcaaccgtttttttagtattatggtacaaatagctggaaaaaagcgggaaaaaggagaatgccatgaaacatctgggaacggaatatctggaaacacaacggttggtactgcggcggtttaccctggaagatgctgaagcaatgtttcaaaattgggcttccgataccgatgtaacaaaatatctcacatggccggcccataaggatgccggcatcagcagaatggtattgaacgaatgggtaaacgcttattccagggcggacaaatatcagtgggcgattgctttaaaagaatcaccggctgaacccattggttccataagtgtggtatacttagatgacagcgttgcctcagcccagatcggatattgcattggccgcaggtggtggcacaaaggaattacttctgaggcgcttaaacgggtaatggattatttgtttgatgaagtagggatgaaccgcatagaagcaatacatgaccctttaaatgccaactccggagctgtcatggctaaatgcggtatgagatatgagggaacaatgcgccaggccggacgtaataatcaggggatctgtgaccactgttattatgccatgttggcctctgacagaagatgacctgttgtaattcaatgaaatgccgggcaatgttttaaattaaggggctgccgcaaaacggaggatccgggccggatattgcatataacacatcagtgcagcaatatctggctttggtcttctttttacggcagccccttgtcatcatatcagcaggttaggtttgattttatccgtattgtgattatttccagcgcttaagagtcggcaataaagctgtcatttcatttcttgcttcttccttgcctatggatttacctaaaacaggtacgatcgtatcgatcatttcttccatagtcatgtccgggtcaataaattttccgcttttataacagtttgtgcagtaaatgcttctgcttccgtcaggttctgttgcaataaagtgagcgtgttctctgttaaaaggtagaccgcagctttgacacatagatacttctgccatttccatcattcctttctatggtgactcagtcaacgatttgctttatattgcaaataaaggctgattttattataaaggagatctgtatgggttgtcaacggcaaaccagacggcttttatgggggccatatttaccggcctgttaaggttctgatgacgggcattaaaatactgttaagatttcccttttcctattcctttttttagtgaatttcattaaaatgacaatagaaaaggaggagtgatttatgaatgccgttattattttgttgattgccgtttatgcggtcataggcgggttgtccaccctgtatctgtttttaagcatgcctgcagttattgtttggaagatctaccggaagtttaaatatcacatatccttaatgaattaaatagtgcataaaatccaaattttattaaagggtgtccctaattatgatttttcataatagaaagggacacccttatgcgttggaaaatgtttcggctctttacgagaatggaaggactgaccaggtcattaaatatttgtaagtcttcgaaacagattatttacatcaagctggccataaccccatacgttatttggataaacagcgggaacttcacgccgtgcacctcttatcaggagacggttaacatcgtatccagtcatggaagtgtaatttcctctgggaatggcccattccatgatcatggctatagctccggctgtgtgggctgccgctgcccctgttccggtaatggttccatactgattccccgggcccgggatagcgcagggaagctggtagcccggagctgcgatatctggtttgaccaggccgtttctcgtatagcctctgcttgattcaatgagtatgctgtcattaaactggttataggcagtaaccgtcagctgatggagcccgttgccgggagaggttatggtggtatcagggtttggattgaggaaaaaagtttcatttgaaataatgtctccggagggcagccaggtatggaaggatatgggttcattttcagtactttgaacccggatgttccagacccctggcaggggatccctgaaacgcagcaatatcagctggtctccggtttcctcctcgaatataaagttattgacccaaatcacgcttggggtgaaaatgaagttgaacattctgcaggaaccgatggtgggatagatcagctgtgtggattccctgtttggggaagatacgtcaacagccagccgtccaagagcgtaaggccatatttccatggagaacaatcggtcctgttcccccactcttaattcaaagtcattgtaaaagggagcctgtgtagtgttgttaaagtaatgcctccggttgtttccttcattcccggctgaaacggaaagaccgattcctggaagccttcctaaatagtttaaataattgctcagggcgccgttgccgtcatggccttcctggctgcttcccagggcgatgcatataaccacgggacggcttacactttgcgcataggcatttaagtagcgtatcccaagaatgatatcggattcctgaaagcacaggatgtcgtctgatacgaaaaaggtttctttaaggttttgctttgcatcctttaattttacaactaacagttcggactccgggacaatgccggaaaaagtaccttctatatttggtttaccggcaatcacgcttgcgatggaggtaccgtggccattggtgtcaacggaaggcacaatggataagggattatctgatctcaaggcaagattaataagctctcttttgtattcggtgccaaatgtaaatccttcaggaggggaagtaccctgtatggactggtcccagatcgagaggattctggtggtgttgtcattataaaggaaggcctggtgccggtaatcaattcctgtatctatgactccaacgatgacccctcttccaaacaggcctaaaaaaggatttcgctgtacggtgccgattcctgatttttcaatgctcacagtggaagttggtacatagagagtcggaaagctgtgataaggataaatacctaagttgcagggatccgagtttgtcttagggatgtggagaagagagtgcctgaaattcagcattgtaatgttgtccccggaagcatacatgggaattgaaacattattaataattaggtcgtagtagttattgtccagaattttttccaaatttcagcctccaggtctgattcgaaaggagtatttgttttatattatgcagcaggagtgctattatgagcagcataaaggtttgttttcttttggatttatgcctgaggctgagaatatctgatactgagcggtcaccatgttaaaaaaatcaccatatattatcaataatatatataagcggagaccaaaggtgaatttcgctgtaaataagtgtgcacagaagatataccttcaacaagctccatttagacagagagaacttgatcccaatagaataagtgtgccggtaggttatcaaatagaagtctttgctcaaggattaaacgcgccaatcggtatggtttttacagatgccggtgatatgctgattggagatgccggaatcggtacattgaatccacgggttatgcgtataagcaatggaagaatagaagttgttgctgatggctttaatgtcccgctgactggaataaactatagaaatggacatatttatgtatcccataaaggagtagtaactgtcataaatcccaatggtgcaagacaggatattataagcggcctgccaagcaatggggacttcagcaataaccgggttgagcttggcaatgatggaaaaatctattttggacagggaacggcaacaaattccggcgtagtaggcctggataacagctgggttcttgagcatcctcatttacatgattatccaggttcctatatatttcttaaccagatcaattttgaaaccagaaatttgctgatacctgctatggaatcagccgttaccggagccttttccccctttggggttcccacaattcaacgatatcaggtgaaagaggggagacttttagcttctggcagcgtattaagagcaaatctggatggctctgatattgaacaggtcgcatgggggcttcgcaatccattttgtatgaaatttgacagcttgaatcggctgatcatatcaaaccagggaatggataccagaggaagcagaccgattgccaatgcattggacgaattacatttatttaatgtgggggcatggtatggctggccggattactcgggggagctccagttacaatgcccaggttcactccgatcagaggcagaaagccagaattattacttaacaccattccggcgtttccgccaacaccaattgcagtttttccgtctggttccaatgtgatgggattcgattttaacgggtcatcagattttggactgattggagatatttacattgcgtgttttggaggagtccaatacgaagaatcaagcgattatatacgttcaggtgtaggacatagggtattgagagttaatgttgttaatggagatatattgacatttgctatcaataaatcagggtttccggaagaaagggggttaagcagacccactgacgttgcttttggacctgataatgcgatgtatatatcagatatggggattgatgatttggagatgcgaaatgtttatttaccaaatacaggagtaatatggagaattacaaaagtaatgatatgatatgctgggtttggcggtaagtgacgttatgacagctaaatttgagggtagctcatttcagcaccagatcattaaaatcattcatgacaaaattaaaactgtttttatagaggaaagaaaaatcattccataaaacgatcatatccgggtatggtgagttgagtgtgctaattaagaaatcgttgaatgcaattggtatttcaaatctctcccaatctgtcagcacgaaaaaagtgtaggtttttagactaaccataatctagaacctacactttttttctttggctgatgctttttggaaaaatggaaaaatccataaagcaaattttgcttttaaaaatatctataaggtaattcaacagaatgcttcctgggaacccaatttatattcatatcagtatacggtaacattcacagtttcattagggaataacaaagcgaaaaggacattaataatcgcctcagagccctaatatcacaatatacttaatgattttacttaggttttgcttcattatcatttaaagccatctaatttatctaaaatcatctaattacttaattgaacaatcgttaaagagcgattcatataacctaaaactggaaaatctgtaataatacttacgcctacttcatctcctgctgataaggcggcttgaaccacaaatgttgaactacttctatttgctatcttaaagaaagtagtagtatcgccaaaaatcggtacaccgttgacagtaattatagcattcagatatggttgatctggatccggatcaacggtggcttcagcgttaatagatatcgttatttgataaattccgctttctcctaccactaattcgttgcccgataggctaactgtgatagtattcgataaaggtccaactatactaaatggtacaggtgtaaatattgccccaggtgtctctacactaccacctcttaaagatccgtaagccaaaacaacttctccagttgggccggtcggtccagtaggcccggcagcaccggtgggtccagtaggtccgacagaaccttcaatcccttgtggtccctgcggcccctgaggtccggtgggcccaacagaaccttcaattccttgcggcccctgaggtccctgaggtccggtgggtccaacagaaccctcaattccctgcggcccctgaggtccctgaggtccggtgggtccaacagaaccttcaattccctgcggcccctgaggtccctgaggtccggtgggtccaataggtccctgggcaccagtagcaccggcaggtccggtgggtccggtgggtccaacagaaccttcaattccctgcggtccctgaggtccctgaggcccggtaggcccaataggcccctgagcaccagtagcaccggcaggcccggtgggtccggtaggtccgacagaaccttcaattccttgcggtccttgaggtccctgaggtccggtaggcccaataggtccctgcgcaccagtagcaccggcggcaccggtcggtccggtaggtccgacagaaccttcaattccttgcggtccctgaggtccctgaggcccggtgggcccggtaggtccttgcgcaccagtagcaccggcggcaccggtaggtccagtgggtccaacaggtccttcaattccttgcggtccctgaggcccggtggggccggtaggtccttgagcgccagtagcaccggcggcacctgtaggtccggtgggtccaataggtccttcaactccctgcggtccggtgggccctgtaggtccctgagcaccagcaggcccagtgggtccttgagaaccggtaggtcctgtaggcccttgagcaccagtagcaccagcaggcccggtaggtccggtaggtccttgggcgccggtagcaccagcaggcccggtaggtcctgtaggcccttgagcgccggtagcgccagcaggtccggtaggtcctgtaggcccttgggcgccggtagcgccagcaggtccggtaggtcctgtaggtccttgggcgccggtagcgccagcaggtccggtaggtcctgtaggcccttgagcaccagtagcaccagcaggcccggtaggtccggtaggtccttgggcgccggtagcaccagcaggcccggtaggtcctgtaggcccttgagcgccggtagcgccagcaggtccggtaggtcctgtaggcccttgggcgccggtcgcgccagcaggtccggtaggtccggtaggcccttgggcgccggtcgcgccagcaggtccggtaggtccggtaggtccttgggctccggtagcgccagcaggtccggtaggtcctgtaggccctggggcaccagtagcaccagtaggtcctgtaggtccttgggcgccggtcgcgccagtagcaccggtaggcccggtaggtccttgggcgccggtagcgccagtagcaccggtaggcccggtaggtccttgggcgccggtcgcgccagtagcaccggtaggcccggtaggtccttgggcgccggtagcgccagtagcaccggtagggccagtaggtccttgggcgccggtagcgccagtagcaccggtagggccagtaggtccttgggcgccggtagcgccagtagcaccggtaggcccggtaggtccttgggcgccagtagcgccagtagcaccggtagggccagtaggtccttgagcgccggtcgcgccagtaggtccagtgggtccggtaggccctacacaacgacagcaattgcattggcaggatttacacgctacattttgttgaccggagcatttatcacatgaacatttatttgcattggcgtaataaccgcaattgcatgcattcatttcgtcaaattcttcaggatacataatgcttcctcctatacattaataaacagcgtaattagacgcttaatgtattatattcgagaaatagttaggttgatattggaaggagcttttgaccctggacaggaaaccgaattttttttgaaaaagaagacgaattaaataaaggggaacataacagatttgtgaatcctatatggagagagccgtatgtgttgttggttgcccagtagaaaaactgctggctgaaaacaagagattaaaaatgaagtgttttaaatggttggtccgataactttagaagcgcgatagctaggcagatgaggactaaaaagggaaatacttgaattggaaggtttgcaaaactccggtaaacgtaaagattttgccagcgattcattattataggaaagaaatcagattgtttgagtctggctgatttatatgatttgtaagtaaattgaactgatattttaggttgagccagcaaggaatacagaataaaccttgctgacttagctgtaatgattaaacattgctctgactttttaatatacagattgttggtacatattcattttatcaatgtggtgttttgaagaaaatggataagctagatgtgatattaatacggttaaggattaagcgacggatacgtttactgcctgtaaaccacgagcaccgttagttgtctcaaaaacgactgactggccatcttctaaagatttgaagccatccatagcaagaccggagaaatgaacgaatatatcgttaccttcctcatcgcagataaaaccaaaccccttttgtgcattaaaccattttactgtaccttttttcatgaaagatacctccttaaaattatattgtatttgtctaaaatcaaaaatcgcatatatgtgtaaatcatcaatagaataatgacttacaaatatatgcgaaatcaaaactttatctaaaatactgatttagtgtagcacggtatctctaagaagtcaacccccaaatcatccattatttttcgatactaaaacgacacttatccacaataatgtggaaataattgtggattacttgttaatgtctgaaaatacgacacaaaaatgcaaatagttacaagcttcgcaaaggaatgaatttgcaaagttcttacagcagtacattagaaaaacaaaaacaccggaaaacctcgtgtttacgaagaactccggtgtttctaccgtttatgggaaactggaagtaatggggctcgaacccatgacctttcgcgtgtgaggcgaacgctcgtcccagctgagctatacttccctatcatggagatagcgagactcgaactcgtgacctatgcgttgcgaacgcatcgctctcccagctgagctatatccccatgaataaattatagcacgatgattctgaattacaagcattatttgtgcaaataatacatgaaattttccaattttcattctgattttgttctacagaatgatgtttgactggcagccttccatccagtttgtgatgttgtcaaatacaatttttgcccgggcctccatggattgctctgaagcaaaggccacgtgaggggtaacgatcgtatttttgcttctaagaagtggatgggccggatccaggggaggttctgtttcaaagacatcaatacctgcaccggaaaggtaaccggtgtctaaggcttcagccaaagcattggaatccaccacaggacctctggcggcattgattaaataagcgccttttttcattttcccaatggtttccctgtttattaaatggcgggagtcgtcgtttaatggacaatgaaggcttacaatatccgcgcgggacaggagttcctcaagggatacgaattcaatgaaggaaggttcgtttccggtcaggcgccgtttgtatgccagaaccttacatccaaaagcggaacaaagctccgcggccctgatgccgatggctccggcacctatgatgcccacagtctttcccatcagctcacatcccaccaggccatcttttgtttttccttctctgcagcgggcttccacttggggcacattgcgaaggagggagaggatcaggcatatggtaagctctgccacggcttccgtggaatatccggccgcattgctgacctttattccccttgatctggctgcttccaggtccacatgatcgacccctgtaaatgcaacatctataaactttaaatgttcgcaggcagatattacctgtccggacagaggcatattggctatcatgataatatctgcctgtccggcccgctggatctgaacttcgggatcagtatccttctgataggcggcaaaatggtgaccggccttgatcagcggttttgcgtattcatttaaaaggctgtccggaatgcccagggattctagtagcacgatgttcataagtatcactccaatcattgtaagaattacagggccgcagtaaatgcggccctgcagattctattatagcactgatggaaggattaaaaaagtaaagattaacagtcttaaatatttgcatttaacctgctatctcagccagtctttctatgatgggcagatgctgtgtgcaaagcttctcgcatttaccgcatttgatgcaggttccggcggagtcttttgatatctgccagtgacctttcagccgttcaaacatatcatttcccagcagcttcatgttgtaggcatccatgaatttggggatatcaatatctttgggacagtgcttgcagtatgcacagcctgtgcagagatcgttgctgatcatgcctttattctcatattcctcatagatttcagctgcgggacgttctgataagttttctacggctttcacggcatcatctacatgagctttcgtggtgcagcccgccagggtgattgtgatctctttgtgggaggccacgaaatttaaggcagcctgtgctacggttaggtctgttccttcagtcagatagcggaatgtattcgggtttccaggtatcaggccgcctcccaatgggttcatgactacaacacccataccactgtcataggcggctttgatgcctgtctggcggaagcggtagttgagggcattgtaaccaatgagcattcctttaaatagattggaagcgactgcgttctccagctcattgccctgcatatgggatgaaaatacgatattgcggatcagtccttctgattttgctttctcaaagaatgagtaaagaatatccacctgtttggaaaaggaatccagatttaatatgcaccacaggtgataaaagtccagataatccaccttcagccggcttagtgtcgtttccagccttctgcgaaagtctgattctgtataactgccgcctactgtgcccagattggtttttgaggaaatatagtaactgtctctgggaagctgggaaagggccatgcctgtgatgatctcgcttttatcatcgcagtaataaggagcagtatcaaaatagttgatgcctttttcatgggcgtacagcgcaacttcagcgcatttttcgaaattgcctgattttacatcgtctgcgtcatatctcatacaacccatgccgatggcggagaccttcatatcggtgttcccatattgtttgtaatacatgttatacctccaggatttatttgtgggtttaaaacgtttttaaagataccccagtgattttaagtgtatttttaaccctgtttcaaggggggtatccggcaggcggacaccggcctccatcaacgcagacagatcatagatccggtgacataagtggccgctgtactccgggtgtttttcaaggtaacctgtcagcggaatctcttttatgttcacatctctgtcaagcagctgcccgatgatctcatagtatcttcggttttccaccgccttcggtcctccaatacagaaaatgcggttataagcgcctggtttgtctgcgcagtccagcatggaatttgctaaatcgtccacaaatacgggctgggtgagatagatcccgccgcctacaagagatattggctcccggtccaggatgagctggggaagttccttctgcctgctgtgctccgggtagcatcccataagaaaaccgggtccgtagatatgaccggggcgaaatagtgtgattgccatggaggtgcttttgaagttgttcataaagacatgttccatacggcgtttattgcctgcataggtgagtgcttcaggctccccttcttcctcgacgaaatatccgtcttctttctgcggagtgcctttcctgcggggatcatatacagaatccgtggaaatcactaccaggcgcttggttactccgggaaatacatttaaatcctgcatggcatgtctttcattcatacatatgcagtcaaaaacaatgtcccagaccgtatccgcatctaaaatcgttttccggaaattttcagcatcgtttctgtcggctttcagaagatggatcttgtcacctaaggggcgctgccctctggtaactgcccaaacttcatattcttcttttgccagggcagccagacggccgctcagtcctccgcttcctccgatgatgagcgctttcttcttcatatcgatcctcctctttatttgaatgcctccacatttttcttcctctccggcgggagcagctttgaaggggggattccttttttttctttaaataattttgaaaaatagtatatatcggagaatccgctttggagagctgcatctcccacgttgccctcgccgctcctcagcatattttccgcatgattcaggcgcagtgatatgagatactgtttgaatgtcatgcctatggcctttttaaacagatttccatagtataccggatggatatggaacagatcagccatggtatcaatgcttacatcttctgcaaaatgagtgctcatgtagcggatgctgttgatgatacggatatctttactgctgatccggttctcattgaaaaggagatccagtatatggtagaggatcaggcacatactggccctcacctttagtttgtaaccgaactcacgcttcagccactcttcgtggatctcatggaagcatgaaatgagctggggaacgctgccaatatggctgattaattcaaggggcagggagatatcatcgcctttctgatctctgaggaaaaggtttgtggagtaacattccatcagatcctcagggacgctgaccgccgctctgtgagtgcctctggggatgcagattaaatcgcctttccggacgatatattctgtaccgtctataaagtatctggcttttcccgcaatgacatatgtgatgtcaatgaaaggtatgtaatccgggtctatcttccaactggcagtacattttctgtggatgtagtagtgcagttcgggaatcatgttatcaaaatttacttccataagctgcgcctcccattatttttttgtcatttttttagaaaaatacggtgactgtctctgatatacgttttttattgtatatttagtatatcttgttcagtaaagttgtgcaatagagaatgcaaagtaaaaaatatatttaaaaattacaaatagtattttaataatacattcacaatattggaggatttggctaaaatataaagcataataaacgtttatttaatcaaaatgctgacacacccaggagaactgtttagagaaaggaagtattatggtaggtatcatcggaacgggcgttattgcagaggcacatcttagggcataccttacactttcggacagatgccgggtagttgcgctgtgtgatatctttcccgagaaagcacagcggctgaaagagaagtatggcctggaggcagcggaagtttatggggattataacgagatgcttaaaagacaggatattgatcttgtaagtgtgtgtaccccgcctttcacccatttgcctgcttccatagcatgtatgagggcaggaaagcatgtgctggtggaaaaacccatggctttatctctggaggaatgtgacgaaatgatagcagtccaaaaggagaccgacacttatttaggagtcgtctgccagaaccgttttacgaaagaaaatcagattcttaaggcacttatagacagcaaacccgttggcagagtgctctttggccaggtggagtcattctggtaccggggccacagctattatgatctttggtggagaggcacctgggagaaggaaggcggaggctgtaccatcaatcatggtgtacaccagatcgatctgctcaactggattatgggtccccctgagactgtaacggctgttctggcaaatattgcacatgataacgccgagacagaagatttgtcagcggcaatacttacctataaaagcggggcagtcgtgacccttgcggtgaatctggtgacccatggccagtatcaaaggcttgctttccagtgtgaaaaggcgggcatctcctctccttatgaggtcaggagcagcagctctacagatacaggatttccggtagacgacccggatactgtggcagagatagagaaggtgcgggaatcgttcccggaaccaacgaaagaaaatcatgaggcgcagattgaacgtgtgatcagctttattgaaaagggagaaatacatccggaggacagtgccgatggccgcctggctcttgaagttattacggctatctatcaatccggatttacgagatcaacagtccgcctgcctttgggaaaggacagcctgttgtatgataaagacggtataaatgaaaacggaaaaaatttccatggggcgaatcaaaacgccgtcagaggaaatcaggaggaacttaagtgatgtcaaaaacaagggatctgtgctggctgaaaaagagagtacatcagccggatatatccagttattatattaaaaatagaagagacagtgttgtaatgaaaaccatagagagagagctgtcccttctgtttgaagacgcagagccgtcggatgatgcaaaatccccgttggtattatcactgacaggtgacggaacaggcgacggatatgagatagaaaagacagaggcaggctatgcagtaacagcctcatctgagaaaggtcttctctatggagtattcggtctgcaccgtattctgatcaccaaaggacggctcccctttaagagccaaccggaccagagcatccgcatgataaaccattgggataatttcgacggctccattgaacgcggttacgcgggagagtcgatctactatgatagaaaccactttagaggagatatggagatcgtccgctcctatgccagactgcttgcgagtacaggtatcaatgccgtatcggtcaacaatgtaaatgtgcataaaaaagagacgttctttataaagagtgagaatttaaaagaaatcagaaagatagccgatgtattcagcgaatacggaatcaggacatatctctctatcaactttgccgctcccatagtggtaggcgggcttgacacggcggatccccttttgccggaagtggccgcatggtgggagcaagtgactgctgatatatacaaagagatcccgcagttcggcggtttcatcgtgaaagcggactccgagggagagccgggcccgtttacatatgacaggacacatgaagatggtgcaaatatgctggcgcggacgatcaaaccttttggaggcatcattatctggagatgctttgtatataactgcggacaggactggagagacagatctcttgaccgtgccagggctgcttatgatatatttatggctcacgacggcaaatttgaaggcaatgtcatccttcagatcaaaaatggtcccattgattttcagatcagagaacctaattctccgcttttcggggcacttagaaagacaaatcagatactggaatttcagattacccaggagtatacagggcatcaggtggatatttgctatctggttcccatgtggaaagagactttggattttgatacctgttatggaaaggatgctttcataaagaatgagatcaaaaagaactcaccggatcccaaacgatcaggaatagcggcggtgggaagtgtaggcatggacgcaaactggacaggcaacaaactggctcaggcaaatctatacggatatggcaggcttgtatgggacaactccctcagttcagaggagatagccagggaatgggtgaatctgacctttgaacttcccgaagaccaggcgtcgaaaattgtggatattcttactacttccagaggcgtttatgaagattatacatgtcccctggcagtgggatttatgtgcaggcccaatgttcactacggggcagacatagacggatacgaatacgacagatggggcacctatcattatgcggaccgcaacggagtaggcagagaacgttcggttgcaaggggcaccggatatacgagacagtattcagatgccagattcagagaatatgaagacttatccacctgtcctgatgagcttttgctgtttttccatcatgtaccctatacccacgtcctgcgttcaggaaagactgtcattcagcatatatatgacacacattttgcaggagcggagaaggttgagcagtacgagaggacctgggagagcctggagcctttcctggatgaagaaagctacaccaatgtgagggaccgtattaagaaacaaaaagaaaatgcaatcaattggcgggatcaaatcaatacatacttttaccgcaagtcgggaatttccgatgctcatggcagaaagatctatgattaaaaaatgtcagttgtgaatggcataaatgaccgcacataataaaatcaggcggcacgggggtcacaaaccctgcaaatataataagaaaaagaaaaggaaggaaaaggtattatgaaaaagtggaagagaagttcagctgtacttgcagcagttttagcggcaacagtcagtttcaccggctgcggaggcaatggaggaggttcggcacagacgaatgcggtaacgtcggggaatgccggtgaggcaaagacagatgccgccggctccggtgagcttgcacaaatcagtttttcctggtgggggaatgacgaccgccatcaggcgacacaggaagctattgacgcatttaatgcggctcatgcgggcgccatcgaagtgacaggagagccttccggcttcgggaacctggaagagacctttgccactcgttacgcaggcggtacggaagcagatatcatgactgtcaattatccgtggctcatcaaatacagtccggatggaactggcttctatgatttggatcagttatccgatatcattgacttttcacagtatgatgggggatttttagagacaggaaagacgggcggtgtgatgcaggctattccttacggacagaacactctgggcgtttatttgaacaaatccgcatttgagagagcgggcattaatgaaatcccgtctacatttgaggagtataaggaagcggccaaagctattacagcacagaatccaaatgcttatttaatcgtaagccccacgttccgttttgctgccgtttattatctgcagcagaagaccggtaaaggcgaattcgatgaaaacttaaatatgaattatacggtagaagactacaaggaagctatgacctggtacaaggaactggcagatcttcatgtgttctgttccagacaggattacctggaaaatgtaggaaatgaccccgtatccatcgcccagaatgcaaaatatattgacggcggatatttgggagtccttgaatggacaggcggtatcgcttccaatgcacagacacttgcagataaaggagatgagctcatcgtagcccccttccgaccatagacggagcagtatttaaaggaaccatggcaaaaccgtccctgacatttgccatttcaaaaaattccaagcaccccagagaagcagcagaatttttacagtatattttaaatgatccggaaggcacaaagctcatgggctccaaaagaggtatggtggcatcaaagtctgcaaaagctgctcttgaagcagacgggcagattacgggagccgtaaagcaggcttatgatttcacggatcaggcagaagttatcaacaactcccctatctttgaggatgccgtatttacaagctcttttgagagcaattatgagaaatacgaattgggagcaagtaccgcagacgaagctgcacaggcattctttgacgaggcagccgctcaggttgcaaagctgaaagctgaatatggaaaataaacagaaataataactgccggttgggaaatcagtccctgtctcattggtcattgcgggtctgcctgtgcagcccgcaatgacaaaccggaaagttataaggtgctttatctgatgtaagaagaactatttcttctgttatctgatttggaaacttattaaccatatagctcttagaggctatatcattcttaactaggaggaatttctttgaaaaacagcaagatcgggcttttgtatattctcccctggataatcggaatggtttttcttacattgtatccgtttattaacgcgctttttatcagctttacggattacaacctggtcagggaaccaaatttcataggatttgccaactatgcgaagctattgaaagataaagactttttaggcacattgagacagacgcttaaatatacggtaatcacagtgcctttgcagcttgcatttgcactttttattgcatttatcctgaattttaaactaaaggctatcaatttctaccggacggcatattatgtaccttcccttttgggaggaaatgtggcggttgccgtattatggcgttttttattccagcaggatgggtttattaaccattttctcggcatattcggcgtgggacctgtaaaatggctatcttccggacctggagccatggctgttatcgtgcttttaaaagtatggcagttcggttctgccatgctgatattcctggcagcccttaaggacgtgcctcaggatctttatgaagctgcaagcgtggacggagcgacgaagccttattcgtttttcaagatcacgatccctttgatcacaccgacgattttcttcaatttggtcatgcagctggtcaatgctttccaggaattcaacggaccttacctgatcacaaagaaaggccctttaaattccacttaccttacctctatgttcatttatgacaatgccttccagctttttaatatgggttatgcaagcgccgcaagctgggtactgtttctcattattgtatctgttacggtagtattatttgctacccaggaccgctgggtattttattcggataagggggaataacatggcacggacaatgttgatcagccaagtggaaagacgcagaagaagaaaattcattataaatgctgttttcagatataccatacttacggtagttgctctggttatgatttaccccattatctggcttgtgggagctacttttaagacgaacaatgagattatttacatcaataaatttcatgcccagcagaatcgattttacgccgtatatcaatggctggaaaaccagaacgaaatttacctttaccacgttttttttaaacacattcagtttcgttatacctaagatcctgttttgtctgataaccagcacactggtggcctatggatttgccagattcaattttccgctcaaaaaggtatttttctccatacttatggcgactatgtttttaccgtcggtagtaacaaggatacctctgtacattttatggaaaaatctgggacttttaaatacttatgtacctttggtggctccaaccttatttgcaaacgagccatttttcgtatttatgctgatccagtttatgcgttccatacccacatatttagatgaggcggcgaccatagacggctgtaattcgtttggaattttaacaatgatcctgctccctgcattaaaaccggcactgatcagctgcacgatctttcagttcgtgtggagttttaatgattttttaggccctttgatctacgtgaccagccttgggaaatatcctgtgtcactggctcttaaaatgtccatcgaccaaagcagcggtattgtggaatggaatcagatcttggccatgtcattcttagctctgctccctgccctgatcctgtttttctgctgccagaggtattttgtagagggagtgaccagttcgggagtaaagggatgagcggtttttgtgtcacaccgtatatatcagatcatgcagttcttcagagaaatgaattcatacccataagaggtacggctggtgcaggagagcgggtagaggccatactttttaaagaagatggggagtggaattcagagaggagaccttgacagaagaagacggaaaatggaaacttgtgtttatgcccatggaggcagggggtccctattccatttccattacatggacaggcgggagaaaagtattttccgatatttatataggagatgtctggctcatgtccggtcagtccaatatgcagctgcccatgcacagggtaagatatcgttttcctgaggagtatggtaaagtcggggatcccctgatccgccagtttaccgtgccggccaagtgggattttaaggcacctgcagacgaattgccggacggaaaatgggaaagttattctttggagtgcgctgcttacttttccgctgcaggatatttctttggggtgaaattgcgggaacgatatcatatacccataggcctcatactcactgcagtggggggaacgccgatcgaggcatggatgagcagaaaagcgcttacggttttttcaggaaaaacaaaggcagacgaccagtgcaaatcagatgactatgtcaggcatatacaaaaggaagacgaagagagggttttgtcgtggtataagaacctggatgagtcggatcaggggattcagaaggattggctgaataccggtatacagaatacatggaatacagtcaatcttaccgatgattttaatgaaaatgaagattttataaagccaggttctgtctggtttaaaaagactgtgaccatcccgcttaagctttcgggcaagccgcttcgtctctcactggggaccattaaagatgcggattacacttacgtagacgggcggtgcatcggaaataccacttataaatatccgcccagggaatatcacttagatggcctgtctccaggggatcatgagatcaccatacgggtgatatctgtatccgggcagctcagctttaccagggggaaatctcatcaaatgatttttggaacaggagaggtgctccctgtctcggaaggctggaagtataaaagaggggcatctatggaagctcttattcctccggtcttttttgagagaaaacccatgggtatgtaccagtctatgatagcgcctcttcatgattttcctatctgtggtatgtgctggtatcagggagagagcaacgcagacgatgatctttcctatcctcagtatttcaagcgtatgatagaggattacagacgaaaatggcatatggggaagtttcctgttatttacgtccagttgcctaattatgatctggaagatgggggaaactggattcaattccgaaatatgcagcaaagccttgcaaagctgccaaactgtgccatggtggtcactatagactgcggcgaatacaatgacttacatccaacggataaaaagacggtaggagagagaatggccatggcggcctatgagattgcatatcatgagccgggggagtggctgtccccaatattctcctgtgctgaaaggaaagatgatgagataatacttcactttgatcatggggatagtggatttactgtatcaggcggcccgcctggcggctttgaggtctgcatatctggaaaatggacctcagattgcatagatgtccggacccaaggcggtacggtgattttgcatgtccaaaaaggagaggcaattaccggaatacgttatgcctggtcaaacaatcctgtgaatggaaatctgcgcgggggatcggggctgccggtatccccatttgagacagtgattgtatgaatgatgggaaaagaaggataatggcataaaatatacaggaccgcagtggacgcggccctgtatattttatttgtaagatttaaacgatgtgatttactttgctgctttttctgaataagtggtagttacaaggtcctcatagggaacacgttcctttaattctccggattcttccagaatgttttccagaagttcaaaactgtctttttcaaaaatggtatcttttttccaggtatcctgcgctttataccgttcaatgatagttgcaatagtagctacgtcggtttctttgaactggggctgaatcacctttgcgatctcttctgaggaatgggaattcacgtattccatacctttttgaatggcattggtgaatttctggatgatttccggattcttttccatatagcttttctttgcgctgtaggcggtataagggatataaccggaatcaacgcccagggaggctaccacgtggccgctgccttctttttcaaggcctgtggcaaatggttcaaactccacggtatagtctgcgtcattgctggtaaaggccgcagcagtcagtccaaagtttatgctctggtcaatggttaagtccgtggctggatcaatgccgtttttcttcaggatgtactcaaataccatttgcggcattccgccggctctcccgccgagtaccttttttcctttcagatccgtccacttaaagtcaggctgaggttctcttcctacaagaaagtttccggctctctgggtcagctgggcaaagttaacggcatagtccttggagccatttgcgtaagtatagatgctggcctctgagcccataaatccgatatcagcatcgcctgatatcaaggcagtcatgaccttgtcggcgccggccccgttgactaaggtcagattaatgccctcatcttcaaaatatcccagttcaatggctgaatactggggggcatagaagatggaatgggcaacttcatttagtgtgaccggagttaattcggacgcttttgcttttgagccgcaggcagtcaggctaagtatagaagctccggtgagtatggccgccagaaaaaagtgataggcttttctcataaaatcctcctttgggaaatcttaatactacattttattatgagaatatgggaaagtactttgtctcagaaaatatttatattcttctgtctgcggcggatacataataaaaaagcggccttatatgctttctggccgttgttctgcagcttgtcagtgagacagccagcgtaaatgccgccagtagtaaggcgattgtccttttcatatcgtgcaccctttctcagtatctcctagtgacattgtatgaaagcggccaggctgcggttcccttttttctttcaatcttatatttctgtattttgagatggaataagaagagaaactgtgttatactgctatagtaaaatttacataacaggagaaatacaatggactatcggatgatcgtgctggatttggatgggacgctgacgaaccggaataaggagatcacgcccaaaaccaaggaagcgctttttgaattaaaacgacagggcggaattattgtactggcttctggaaggcctacttacggggtgatgcctcttgcgaaggaactggagcttcatgagtcaggaggttatattctgtcctttaacggagggcgcatcattgactgcaaaaccggggaaactgtttttgcaaaggaattgcctgtgtcttccaattccagaattatccgcatggcaaaggatcatggagtgaacattctgacctatgagaatgatctcattgtcactcccaatgccggagatgaatatgtggaaaaggaatcagccattaacaagctggaagtaaaagaagtcggtgatatggaggcttatgtacagtttccggttgtgaagttcctgatgctggaagagggcgattaccttgccatggtggaacccagggtaaaagcagctttagggcgggattacagcgtttaccgctcagagccttattttttggagattcttcccaagggaatagacaaggcggcaagtctggagcgcctgctttcaaggcttggcatgagccgggaagagatgattgcctgcggggatggctataatgatctgtccatgatccggtatgcagggcttggagttgctatggaaaatgcagttcttcctgtaaagacggcagccgattatataacctgctccaataatcatgacggaatagcctgcgttgtagaaaaatttatgctttcctgatgtccgcggagggtggactttacaactttaatatgttaaaatgcagctgagagcaaaaacaagaaaaaggggattgatcaatactatgaataaaaaaattaagacagatgcggtagatcatctgtttgaggccattttgaccttaagatcatcggaagagtgctatactttttttgaggacgtatgtaccgtcaatgagctgctaagcttatcccagaggtacgaggtggcgaaaatgctgcgggagggccgtacttatctggaaatcgcggaaaagacgggggcatccactgcaaccatcagccgtgtaaaccgctccttaaattacgggaacgatgggtatgatatggtgtttaagcgtttggaagaagagaagagagaaggttgatgaaaacagggacaagcctggagttggtacttgcccctgtttttattataccatgaaggcaatgagccaagcgccgcaaagcggcattggccttattttttctttttcatgttaacaggctcggtttcccttaaatcatcaatgatctgttcaatgatctgcttttttaaatacacatcaaaggaaagctcacagatccaggaaaaaaggcggagatattccagatcatcttccggaagccctttgtcttcaaaggttttgccggcatgctgatgtttttggataatgtcttctttgatgcggtctatgcccccttctacctgagagaagatctccctgtagatgtcctctaaaggaatcccttccggagaattgaaatgtttttccgtaataggccggaagagctgttcaatatcatggaaggaaagcagatttttaaaataatatataaatattagaagaaaaatgtgttctctggagtatttctttttattaggagccggaaggagattgttctttgcataattattgatcatggtttttgtcagaaccttgtcttccggatggcgtttggtatcctttaaatgctcatccataaaagtggtgacctgatccatgtacagatcaatattaggaatggtttccggtctgatatgatctaaggattccagatactttaggatgtcctgcattctttcgtcgttggttttcatgtgttttcctctttcctgcccatgccttttgagctaaaggtttgcccgcagggcgccgaccttctgcgcggccgctgccgcacacgagggatgatcccctttattatatcatattatatagtattcaataccagatgacaagggggaaaaagatataataaactaaatttttttaagaataccttaaaaagtttcttgacttttgcagaatgtgtgctaatctagaattatcagagagatgaacgaaaggagtcacattattatgaaaaaagtattagcaacagaaaaagcgccggcagcaatcggcccatattctcagggcgttcgtggaggcgattacgtatttatatcaggacagcttcctattgaccctgctaccggcgagtttgcaggtgatgatatcgtatcccagacaagacagtcgttgacaaacatcaagtccattctggaaagcgaaggcttatccatggataatgtggttaagacaaccgttttattaaagaatatcagtgagtttggtgcgatgaacgaagtttatgcatctttctttgcaggagagtgtccggcaagagctgcatatgaagtggcagcacttccaaagaacgctcttgttgaaatcgaagcaatcgcttactgcggcaagtaatgagccggatcagtttctgagaatttgttttaagggaacgaatgcagggagtacagcactttgagatgctttacagcgtttcagagggcttgctctctttttgtatttctgtaaatatgaggcacatttcaagggcagttgtagaaataaagggctttttgcgaaagaaatgggttgcatattgacggacatatattataataaactagatagtccgattttttttacccgtcggacggctggttttccggatcaggccccattggggcggtgttcaggaggaaaatcaggcttgaaattgagatggaagctggtacactaacgatgaagattgacgaaacggcagaagaatatctgggtcggattcccatgtggaccagaaagaaaaactctctggaagatatccggaaattcctttgtgaaatgggggaaccggatgaagggatgaaaatttttcatgtggcaggtaccaatggaaaagggtcggtatgtgcatttttacagtctgttttaagacaagcaggctataaggtaggtacctttacctctcctcatctggtggaaatcagagagcgtttctgcataaacggagaaatggctgcagaaaagttttttgaagaaagttaccgggcggtcagaatcgtttcccagaatatgatggaaaagggctattgccatccgtcttactttgagtttctgttttatatggcaatggacatgttccgtaagttggaagtggatattgtaattctggaaaccggccttggaggaaggcttgataccaccaatgtcataaggcatcccctggtgtcggtgatcacctccatcagtctggatcatacggaatatttaggagataccattgaaaagatcgcatgggaaaaggccgggatcataaaaaaagggattcctgtagtctttgacggaaacgacaatcgtgcttcccaggttatccgcaccagggcagaggagcttggttctcctttccaagaggcggacatgcaggggtatgagataaccggatgcaaagataagggctatgaagtgagattttttagagccgggggagattttattgaggttaccgttccgactgtggcggaatatcaggtgatgaatgcttttctttcctttaaagcccttgaggcagcggggcttgagaaggccgatggccttcctataacccagttgcagataaaagaggggatcgcccgaatgtactggccgggaaggatggaagaggtgctgccgggagtattccttgacggagcacataatccgggcggtattcaggcttttgccaaggctgcggccggtttatgccaagggagaaagaaacgggctgatcttttgttttcgtcagtatccgataaggatcatggtaaaatgataagggaaattgcggaggcgctgcctcttgaccaggcggcagtggctcatattaattccgagagaggactggaaacaggggtcctgctgaaagagtttcaagatgcctgcggctgcggtgtggaaggatttcagacagtagaagaggctgttttatacatgcttcataaaaaggatgaagggcatctgctgttttgtgtgggttctctttaccttatgggggagataaaagcagttttaaggaggaacggatatgattgattttgaagccgagattaacagctacaggccaagcctggaggttgatgccattgaagatgccattgtaagaagtgatctgacagatatgaatgacttaatgatggatctgataaaagaagtcaacaaggaataggcggttaagatatggattatgaaagaaaaaccagggtaatcgcaaacagttattataacatagggctggaacgggcaaaactcagggatttgtcaggcgcatccgaatgcttgaaaaaaagccttcattttaacaagtatatgacagatgcaagaaatcttttagggctgatctattatgaggtcggtgaggtcggagaagctcttgtgcaatgggtgatcagcatgaacctacagcctgaggaaaaccgtgcggatcactacctgggcgagatacggagaaaatcaggcacaatggaggctgagcggcgcgcggtaagacggtttaatcaggccttgatctatgcccagaacggaagcgaagatctggctatcctgcagcttaacaaggttgtggaaagtaagtctaattatgtgaaggcccagctattgctggcactcttatgcattgccagagaggattaccagaaggccgggaaagcagtttacaaggtattgcagattgaccgcaatcatcccaaagcgctttattacaaatccctggtacaggatggcggggggagcgtaaaaaatgaacgggagccggaaaaacggaagctgaaaaatgtgctttctcacaggcagatggaagatgatgatgtgatcatccctccaagctaccgggaaaacaccaaggatcaggcggtttggaacattcttgccggtcttttgctgggggctgcggtggtcttttttctggtaatgccggccaataccaagtctattaatgaaggccataataatgaaatgttaaaatacagcgaagcgttgagccaggccaaccagaaagtcgacagcctgacagcacagctggaatccctggatgcagataagaagactgcagaggctaccttagcctccctcaccagtgattcagacagcgttctggcccagtatcaggctgtgatcggaattcttcaggcatataagaaagatgattttccgtctgcggtacgtatttacgccgggttgaacccggatctcatcgcttcccctgatgttcaggcggtaatcggtgagataagaaaggatatgacgcagaacggctgcccgattttggaaggtcttggggacaaggcaatggaggcaggagatgctccgactgcccttgcttactatttaaaatgcattgatttaaaaccggacagctggcaggcaaaattcaaggcagcggtcatttataaaggaatggatcagaaggaacaggccaacgggctgttctccgacatcataaataacagtaaagatgaagagctatctgcaaaggcaaaatcagaacgtggtttttaaggtgcagaaagcaggaaaagacactacagaagagatttttttgtggtgccttttttgttctacggttcttttccagagaacaaaggcgttcttttctggtattacggacagacaataaagaatggaggagtattgcatatgaatcaaccatactttacatatgaggcagatggacaagccttaatcgttcatctgccggaggagttggatcatcataactgttcagggcttaaatacgaaactgatttaatcctttctgaaaactatattaagcgtattgtttttgatttttcaaaaaccaggttcatggattcttcggggattggtattttactgaacaggtataagcagatggctttaagcgggggtaccgttagtctctacggtgcaggtccccaggctctccgcattcttaaaatagggggcattttaaaattaatgaaattatatgactctaaggaagctgcagtcacaggttgaggaggaacgtatgtcagaacagaataaaccagaaattctgaaaatggaattggaggccctgtcaaaaaatgaagagtttgccagagtggcagtggctgtttttatggcaaggttaaaccccactctggaagaggtggatgatgtgaaaacagccgtgtcggaggctgtcaccaatgcggtcatccatggatatcaggggcagggagggatcatttatttggaagtgagggtagacggacaagagattaccgtaaccgttggggatacgggtatcggtatccctgatatcaagctggccatggaacctatgtataccacagaccctgacggtgaacggtcaggcatgggattttcctttatggaagcgtttatggatcaggtggaagtgaagtcggcgatcggagagggaactgccgtgaccatgaaaaagaagattagcaggtgagccttatggatgagaccatgagattgatacaaatggctcacgaaggagataaagcggcaagggatcagcttgtgaccgacaatttcgggctggtttggagtattgtacgcagatttacagggcgtggttatgaacctgaggatttatttcaaatcggcagcatcggcttaatgaaagccatcgataaatttgatttatcctatgaggtgaaattttccacttacgcagtgcccatgataacaggagagatcaagcgttttttaagagatgacggaatgatcaaggtcagccgctccattaaggaaatggggcttaaggtgaaaaacgtcagggaggaattgatatatcgtctgggaagagagcccacggtggaagaaatcgccggagaaataggggccagcaaggaagaagtggcggcttccattgaggcaggagcggaagtagaatccttataccggtctgtcaacaaaaatgacgaaaacagtattttactcatagataaaattgaagaagaaagctccgcacaggaagagcttttaaaccgcatggtactaagggagcttttaacggcactttctgacaaggacagggaaattattatcaggcgctattattacaatgagactcaaagccagattgcggcaaagcttggaatatcccaggtccaggtttccaggctggaaaaaaagattttaaaacagatgcgggaaaaattgtagaataaaataattttatacggctcatactagctttgaaaaaccagagaaaaggatgtgagcacgtatggaatccgtaaaacataagcttgtcatggcgcttcttgtgttatgcctgattgcagtggccgctgctatctggtatatgatcgctgttatgccggatggggcggaaaaagaagggacgcttgtagaagccattccgggattggagatgatggtttcgtgagcaagaccgtttatttaaatatcagccagattacagaggtcaggcacaaggagatccagttaaaggatgtggcagatgtttattgcgatgattcggctattatgaacaagtgcaaagcactccgtatcaaaaccatccatctggaccgaaacaagcggtatatagaaagtactctggatgtcatcaagaaactgacggaaatggattctactcttcagatcaataatgtgggagaggtaaactttatcatagactaccataagcccaagcctcccagctgggtctgggagtgggccaaaaccatttttgtctgcatcgtatgtttctgcggcgcatcctttgccatcatgacctttaataatgatgccagtgtttcggacgttttcaaggaaatttaccggatcatcatgaagcaggagtccagcggattcacgattttggaggtcagttattccgttggactggctttgggaatcgtgggatttttcaatcatttcgcaaaatacaagatcaataccgatccaacgccgctggaagtggaaatgcggctttacgaagacaatatcagtaagaccctgattcagaatgatggaagaaaggagtcggatattgatgtttcttaaagaagtattccttgtttttattgggctcagcgctggcggcattatagcagccggcgtttttgcttttctggcaattattggcatatttcccaggctgattggaatcacccatacaaaaaagcatattatgctttatgaatcgctgatcattcttggtggagtccttgggaatgtatgggatatttatgaatttcccataggatttggcggaaatctggttcttggaatatacgggctgtcgtcaggaatctttgtaggcatccttgtcatgtcccttgcggaaacattgaaggccctacccgtaatcagccgaaggattcatctggccgttggactgcagtatttgatcctttccctcggacttggcaaattgatcggttctctgctttattttacagggaatcttgggaagtgacaggagtcaaaggatttacagaatggaggaaaaacatggaaataaacaaaaaagcatacgaggcttatgtaaaagaggtgactccggtccataaaagatggccggggctaataaaggcttttctggtaggcggagccatttgcctctttggccagttcgttaccaccttattcatgaattggggcctggaaaaggaagcggcttctgcctggaccactctggttctgattgcagccagtgtcatccttaccggatttaacatttatcctaagattgtaaagtttggcggagcaggtgccctggtgccgatcacgggatttgccaattccgttgtagccccggcggtggaattcaaggcagagggccagatatttggaattggctgcaagatttttaccattgcaggccctgtcatactatacgggatattaagctcctggatccttggaatcatcgcctatgtattaaaggccttccgcatgctgtaggaatgaaccggtcagagaaatggagagagaaaatgcagataggaaaagcgagtattaaatttgaagaacctccgattattgaaagcatggcttccatagtcggtaaaaaagaaggggaaggtcctctgggaaaactgttcgacgtggtggagcaggatgacatgttcggagctgatacctgggaaaaagcggaaagcgcccttcagaagcagacagctgatctggctattgaaaaaggagatatccggaaaaaggacattcgctatttatttgcgggagatttactgggccagctgatcgccacgtcctttggaacggtggatttggaaattcctttattcggcctcttcggagcatgctccaccatgggagaggcgcttaatctgggcgcaatgactgttgcagggggctatgcggacaaggtcatggcaatggcttccagccactttgcaacggctgaaaagcagttccgttttcctctgggatatggaaaccaaaggccgttttccgcttcatggaccgttacaggctgcggcgcggtggtgctcaccaagaacaggaaagaagggatcgcagccataaccgggatcacaaccgggcgcatggtggatatgggaatcaaagactccatgaatatgggagcagccatggctccggccgcctttcatactattcaacagaattttgatgattttcaggtggatgaatcctattatgacaaaatcatcacaggagatttaggccaggtcggccggacgatcctccttgatttcatgaaaaataagggacatgacttggaatcggtgcatacggattgcggaatcgaaatatttaacagcgaggagcaggatacccatgcgggaggaagcggctgcggatgtgcggcttccactctttgtgcttatatactccctaaagtacaagacggtacctggaaacgggttctgtatgttcctacaggcgctctcctttccacagtgagctttaacgaaggtgagacgatcccaggcatcgcccatggggttgtgattgagaatgtaggaaacctatagcccgcattcataatttggcggtgtatttccgtcaaattatgaatggcatggcgtcgtatgtttactaaattaaaaatggcattaccaacacacagccagtataaaagaaaggagacagccatggattacgtgaaagcgtttttagtgggaggagtgatctgcgctctggtgcagatattaatggacaatacgaaattgatgccagggcgcatcatggtccttctggtggtgaccggaagcattctgggagcaattggaatctaccagccctttgccgactgggccggagccggggcaacagttccccttctgggctttggaaacaccttatggaagggtgtatggaagagcatgggagaggatggattcttagggatttttaaaggagggtttacttccagcgccgtaggaatctcgggagcattgattttcggatatttaggatccgttatatttaaacccaagatgaaaagctgataaagttgtgataaaaaaagaagagcagttatagaaagggtgccggaaaagttaatttaacttttccggcaccctcgtgtttttttcttaataacctccccaaggaggaatctgcgttacgcctccgggattctggggcgtatatccaggtccgaactgctggggaattccgccggacgagtctgaatcatctcccggaggaaggatgatggagttggcggaatggatggtgcagtagcctggcatagcgtatttggaatcatctgttgccccttcttctcccgcaggaattgccatgaatatggctgtagtccgctccggacaataaggagtaggcagacggtgggatacggagcaaaccgtagcccgtacgtggttgttgcatacgtccgtgggaacagtaccctttgcaaaaaattccgtgtataccgcattgcctctggggtcattattacagattccggagactgccagcttgccggattttcggcagatctgggcggtttctatgctgtcaggaaccgtaaatccgggatcagacattccttcatggaccctggtcatgattttcctccagatagctttgtggaaggaagtgcctccgttttgttttgtcagcttctggttgtcatcgcagcctgcccagataccggcagtgtaatagggggtaaagcctacgaaccagatatcattgtttgcggtggttgtaccgctttttcctgctgccgacatgcctggaatatgagcggcggcgctggtggagcttggccccgcgcttgaaaacttcctgctgctttccatggagtctgacatggcatcggtcagaaggaatgcggtggaatcctttaatacccggtgagtttccggcgtattatcaattaacaccttgccgtcgtgatccagaatcttggtaaagaatatgggttttttataaacccctccgttggctatggtggcaaaggcgccggtcagttctaagttggagacaccggtggtgattccgccaagggcaagggccgggttataatccgtgtcagttaaagaggtgatgccgaaattcttggcatattccaccccaagctgaggtgttacggtctccatcaggcagcggacggcaacgatgttcatggaatagatgattccgtcccgtatgctggagtaaccctgatagccggaactgtaccagttggaaaacgttttattgcctaccgtgtaaacggaatcgtaataaaccgttccaagggtggccccgcaggtgtcaatggcaggtgcaaaggctgttaagatcttaaaggtggagcctggctgccggtatgtgttgctggcccggtttaaggtcaggctggcagttttctgcccccgtccgccgctaatggcctttacttctcctgttgtctggtccatgagaacaaaggaagcctggggctgcagcgtcttatgaaggctttctcccagaatggtatccccttcttttaaaagataagccttgtatccgtccacatcggcctgaaccgcttcttcggaattatataggccgtcatacccggaatctccgttttccctgtggtaatgctttatattctcctgggagtaatgggtggtggttccatccttgtgagtaactgacagtctgtattctatggaatatctggctgcggaatagttttcaggattgttgatctcctcgtctacaatggtctggagcttgggatcctgggtggtataaatggacaggccgccgctgtacagtaagttgtgggcctgggtgtccgtataccccaactgatccttcatggcccgtttgacctgttccaccagctcatccgtaaaatagctgtatggggaggaagtttcttttgtggcggtgtcaacattctggattctggaatacacatcgtcggacagggcattatcctcttcttcctttgtaatatatccctggtcaagcatgtattggagaattactttttgcttgtccgaattggccttttgtcctgtgattgggttaaactttgacgggttctgggtgattcctgcgaggacagcgcattctgacagggttaaatccgatacattcttattgaaatatctcctggctgctaccttgactcccagggaattgttgcccaggttgatggtatttaagtagttggttatgatctgctccttggacatggctccgtccagcttgacggctaaaaaccattcctgcagctttctttccagccgctccccaaagctcttttccatcccccgccgaatacgctgtttttaatcagctgctgggtgatggtgcttcctccgcctgccgtggaatcgcctgtcagcacgccttttacagcgcgcataatggaacgcaaatcaattccgttgtgctcccagaacctggaatcctcataagaaacaaatgcattgataagattcttgggcagttcctcataggtggcctcctcccggttggaacctgcggttaccagggtttcagtgacgttgccggcactgtcatagaccgttgttgcatattcatttggaacaatggttgcaatatccacttcaggagcattgtctatgataccttttgccatgccaaagcagacgctggcgacaacgatgccgccaaataagcacagcacaaataaactctttaaaaaggcaagaaagaccttggtggtgtatttccttgcttttgaattggcagatctgatttttttctctgttgattgtttgccgtaattcataggaaacctcctttaccggttcattataccaaaaattgtcgtacaattcaacacttaccatttttggagataatcggacaaaatatacatgaaagcttgcctggaccaggacttttggatataatgaaaggaatcggttaaaagaaggaatgaggaagtttatgagaaaggcttacaggattttgtatcagggaggcacaggggaaataacggaaaaaaagtcccggttcattgccggtttaaagcctgtggaaacagaagaagaggcgctggcttttattgaggaaacgagaaagcggtattgggatgcaaggcataactgctacgcctggatcataggaaggggcggggaggaaaagcgcttaagcgatgacggagagccaagccagaccgccggaaaacccatgatggatgtgctggaaggcgagaagcttgtaaacctctgcgcggtggttacccggtattttggaggcacgcttcttggtacgggaggcctggtaagagcttattccaaggcagttcaggaagggcttaagaattgtacggctttgaccgtggaaccggcagtaaagctttctgtgactacggattacaatggcattggaaagatccagtatcttctggggcagcaggagatcacgacccttggcgttgagtatacggaccgggtggagcttacggccctggttcctgatggagctctggacaaggttcgggctgatattacagaagcgaccagcggaagagcagggctgcatatgtcaggagaagtttattacggcatttttaataaagaggtgattttgtttcctggatgagaattggaaggctttaaaaaagtgtcgaaaaaacagaaaaaatcttgcaatatagaatttaggatgttatactgaataattgtgataatgtaaatgaaactaagggcggatacggtccttagttttttatgatatgggaacatgattgcctgtattataaaaatgtactttgtccggtataccttatgacggacaaagtacattctttgtttaaagaaaagaaagaagagtacattttatgaagatgaaaagagaagacgtaagaaatgtggcaatcattgcccacgtcgatcatggtaaaacaacgctggtggacgccctgcttaagcagagcggtattttccgtgagaaccaggaagtcatggagcgtgtcatggattccaatgatattgagagagagcggggaatcaccattttatccaagaatacggccgttcattataacgggaccaagatcaatatcattgatactcctggccatgctgacttcggcggcgaggtggaacgcgttttaaagatggtaaacggcgtaattctggttgtagatgcttatgaaggcgttatgcctcagacgaagttcgtgcttcggaaagccttggagcttggcttatccgtagtgacctgtattaataagattgaccgcccggaggcaagacctgaggaggtggaggaagaggtattggagcttctcatggacttagatgccagcgaagaacagctggactgtccctttatctatgcttctgcaaaagccggctttgccaaaaaagagcttgaagatgaggaagttgacatggggccgctgtttcggaccgtaatcgatcatataccggcgccggaaggggacccggatgcatccacccagctgctcatcagcaccattgactacaatgagtacgtcggacggatcggcgtaggcaaggtggacaacggaaaggtaagggtaaatcaggagtgtgtgatcgttaaccaccatgatccggataaattccgcaaggtaaaagtgggaaaactgtacgaatatgaaggacttaacaaggtagaagtccaggaagccaccatcggcgccattgtcgccatttccggaattgcagatattcacatcggcgataccctctgttctccggaaaacgcggaagctatcccgttccagaagatatcagagcctacgattgcaatgaattttatggtaaatgacagccctcttgcgggacaggaaggaaaattcattacatcccgccatatcagggagcgcctattccgggaattgaatacggatgtcagccttcgggtggaggaaaccgattctcctgattgctttaaggtttccggacgcggggagcttcatctgtctgttctgattgagaacatgagaagagaaggctttgagttcgctgtcagcaaggcggaggttttataccgctttgatgagagaaaccacaagctggagccaatggagatcgcttatgttgacgtaccggaggaatttacaggagccgttatccagaagcttacaagccgtaagggagagcttcagggtatgagcccggccaacgggggctatacaagactggaatttgccattccatcaagaggcctcatcggataccggggagagtttatgacggatacaaaaggaaacggaatcatgaatacggcatttgacggctatgcgccatttaaaggagaattatcctaccgcaagacaggatccctcatcgcgtatgaatcaggggaatccattacctatggtttgtttggcgcccaggaaagaggaagcctgtttatcgggcctggagtaaaggtttattccggtatggttatagggcagaatccaaaggcagaagacattgaaatcaatgtttgcaagacgaaaaagctgaccaacacccgttcttccagcgctgatgaagctcttaagctgaccacgccaagggaaatgagcttggagcagtgccttgactttattgataccgatgagctgctggagatcactccttcaaaccttcggatcagaaagaaaatattggatcctaccttgagaaaaaggtcatctcttaacaaaaaatcattgacgtaaattgtaatattaaggggaatgctgccttcattagccgaaaattcggcaatgcggcggcattcccctttattttcttgggaattctgccttgttgtgtcgatatttttggattgttttctatcattttaggggatcttatgacataaatttaatattagctgtgaagcatattagcaaataagtgaaagaagaggggaaatacaatgtcagaaaaaatgattgaaaacaacaaagtgagcgttatcggagagatcatctccggcttcaccttcagccatgaagtatttggagaaggattctatatggtggatgttgctgtaaaccgtctcagtgaacaggcagatgttataccgctcatgatttcagaacgccttattgacatagaaggggattacaacggcttaacagtggaagctgtcggccagtttcgttcctataaccgtcatgaaggaacaaaaaaccggctggtgctttctgtttttgtgagagaaatccattttatagaagaatttacagactatacaaagaccaatcaaatttttctggatggatatatctgcaaagctcccatttacagaaaaacacctttaggcagggaaattgcggacctgctccttgcggttaaccgcccatatggaaaatcagattacataccctgcatcgcatgggggagaaatgccagatatgcttccggattttcggtaggaacaagagtaaaggtttggggtagagtccagagcagggaatacaccaaaaaattaagtgaaacagaatgtgaaaaaagagtggcctatgaagtatcggtcagcaagctggaatgtgcggaataggaactgtcatttataaataaggaatgccttacggtatatctctgcacccataaaacggtgcggccttactaaaaaaagcatggaaataataaggaaatgttaagaaaacttgcaaaaaaattaaaattatgatacgataagcgggttctaacataatatgtaaataattgctttttagctgttatgaggtgctgaaggatgaatagaggtgcaatacaggttatttgcggggaaggaaaaggaaagactgcagccgcgctgggtatgggaatcggagctctgaccaggaacagaactgttatcatgatacagttcttaaaaggctgccccggccgggattcatttgatgtaatgaaatgtctggagcctgagatgaaaatattccggtttgaaaagtccgatggtttttttgaaagcctatccaaagaacagcaggaagaggaacggagaaatatccgcaacggcttaaattttgcaaaaaaggtcttatcaacaggggaatgcgatatgctgatcctggatgaaattcttggactgctggaccagaagatcatagaggcagaggagctgataaagctgcttcagtctaaagttgatgagatggaagttatattaaccggtaaagtatttcaaaaggaaatagaaccttatgtagacagtattctggaaatcaaccatgttaaagttgacaacacaaaataataatgatagtatggtaacatacataatagagtagaggttgcgttgcttataagtactctgtccgatgtatcaggtacagatgagggcagggggaaggaagaaacgccgaagaacggtatggcctgagcgtacctgttctgggcatatggttaagagccatatgactgtcatccaatcggatggggagctacttaaagaaagatgagattaccagattctgaactttaagagctgaccctgtgtcagctctgttttttttcacaggagattacgctctgtgaatcaaaatacgctccgccatggaagcccaggatacacaaatgcaccatggccgctaaggtgctcctttttggagcggaatctggttcgcagactccttgctccgcagattatggaccggatgaaagtttactgtgtatgacgaaaaagaatcaggaggataatattatggcaatttttgaaggcgcaggtgtagctcttgtcacaccatttaaagaaagcggtgaggtaaactatgagaagctggaggagctggtagaagagcagatcgcttcgggaactgactccatcattgtctgcggcacaacaggcgaggcttcgaccatgacccatgaggagcatttagacacgatcaaatacgtatgtgaagtgacgaagaagcggatccctgttatcgcaggaaccggctccaactgcacggatacggcggtttatctgtctaaggaggcggaaagccaaggtgcggacgggcttcttctcgtgtctccctactataacaaggcaactcagaacggattgaaggctcactttaaagccgttgccaatgaagtgaagattcccattatcctgtataatattccggcaagaaccgggataaacattgcggccgagaccatagctgatctttgcttaaatgttgaaaacattgtgggcgttaaggaggcgagcggcaattttacagccatcgcggatttaatgagcttaacagacggcaatgtggatctttattcaggcaatgatgaccagattgttcccatgatgtccctgggaggaaaaggtgttatttctgttctttccaacattgcgcctgcccagactcacgaaatctgtgaagcttattttaagggagatgtgaaacgcagcgccgctttgcagctggcagccattcctctcatcaatgccttattctgtgaggtcaaccccattcctgttaaggctgccttaaatcttatgggaaaggccgcaggccccatgcgtctgccccttaccgagatggaacctaagaatcaggaacgcttaaaactagccatgaaagagtatggaattctgtaatcggttaacgatatatgatacatggaggaaataccctggggattcctttgcgcccggaaagcgtgggcacagtgtgacccagggaagacgccacagaagtgtctgaccgtgggcaggaaagaggaaacaccctgcgggtatacctttatgcccagaaagcgtgggcaggaaagaggaaacatgattaggatgataatgcacggctgtaacggggccatgggccaggtggtgaccgggattgcggcagaggaaaaaaatttaaccattgttgcgggtattgatcccaatgatgccggccagaatccgtatccggtatttccgtctcttgaggcctgtgacgcggaggcggatgtgatcgtggattttacctctgccaaagcggtggagggtcttcttgaatacagcgtaaggaagaaaatacctgtggtagtttgtaccaccggcctttcagaagaacagatgaaaaagctggaagaggctgcaaatcatgttgctgtccttaagtctgccaatatgtctcttggagtgaacctgcttatgaagctggtaaaagatgcggcccaggtccttgctgctgcaggatttgacattgaaatactggaaaaacatcacaataaaaagctggatgcccccagcggaacagcccttgccctggcagattccatcaatgaggccatggatcaggaatatcattatgtttatgacagaagccaggtaaggaaggccagagacaaaaaagagatggggattcagtctgtccgcggaggaaccattgttggagaacatgatgtgatttttgcgggaaaggatgagattgtcacctttcatcacaccgcttattccaaggctatttttgcaaaaggagccgtttctgcggcaaagtttctggcaggaaaagctccgggattatattccatgaaagatgtaatagattcataaattttccaatatcttccaccataattcgttcatcctttacacatactaatcgtagaaaatgaaaggagaatgtattatgaagagaataaaaccatatgcaattacacttattgtcatcatggcagtaatgtgtatgactgcctgcggcaccacgaagggaaatgatggaacttcagcaggtactacagcggcaacaacccagacaacagcagcaacgacgacaaaagaaactactgctgcaggagctacaacaggtgctgatgagagcactggtgtggttaacggagtcgttgatgatgtagaaaaaggggttgacaaaatcacaggggaaagcaatggccagccaaccactgatgctacaaaggctcaataataagaaggttgaaaaaaagcttcaggcatggaatcaatgcttgaagctttttttaatataagttataatggaaacaagacatatcttgccgtattttaaggcatttcttttgatttttgtttaaacgcccatattccggacagttatccaataaaaatgttaaaaaaataacatggcctgcttggcagagaggcagaagatatatgaaagggaaatttgattattttaaatatcagaggtataataaaaagaggaaaaagccctggagaagtcttaaacggtttattcccaacggagaggccagaaacatgcgcataagaaagagtctgattcttttcctcgttgtggaaggagcagtgatttccctgttccatgaagaaattgcggggagcaatgttcccgcctttctccttgccggacaggaaatggctgaggagaaggaagtgacgtcggaagacttctggggccggaaaaccggggaaacaagggaacagggagtttcttttgactggaaggaaggcacggttaagctgtggcagaaggtggagcgtgtgatccttcaggggcctgattgagaaacaaaatcccatggtggtcataagtatttataataataaaaccagttgcaatcccatttttactgtattataatttctactgaaacaccgtagttttatttgaaaaacttataaattaattcagaaaaggacaggtggctattgtggagaaaaaagaattgctgtatgagggaaaagcgaagaaggtttatacaacggaagatccggatatattgattgtttcatacaaagacgatgccacagcatttaatggccttaaaaaaggcaccattgtaggaaagggcgcggtcaacaaccggatgaccaactttatcttcaagaagctggaagcaaaaggcgttcccacccatctggtgaaagagttaaacgaccgtgagaccgttgtaaagaaagtggagatcgtgcctcttgaagtaatcatcagaaactactccgcaggaagctttgccaagaagatgggtatggaagaaggcataaaatttgcctgcccgactcttgaattcagttataaaaatgacgacttaggtgacccgttcatcaacgactattatgctttggccttagagctggcaactcaggaagagattgataaaatcacggaatatgcctttaaggtaaacgaagtactgaaagaatattttgacggtttaaacattgatttgatcgattttaagattgaattcggccgttatcacgggcaggtcattctggctgatgagatctctcctgacacatgcaggctgtgggataaggatacccatgagaagctggataaggaccgtttccgcagggatttgggaggcgtggaggacgcatacgaggaagtattccgccgtcttggcatcaggtaaacagcacagggaggaaacaccctgggggtatgcctttacgcccgatgccccataaagcggggcagactctcaagggggcgggctttgcccaaaaaccatggacaggaaagaggaaagacatctgatgaataacgaatgggattttaattttgaggaagagttacatgaggagtgcggcgtattcggaatgtacgattttgacggaggcgacgttgcttctaccatttattatggattgtttgcgttacagcacagaggccaggaaagctgcggaattgcggtcagcgatacagaaggccccatgggaaaggtaagcgcccataaggggatggggttatgcaacgaggtctttacaccggaaattttagaaaacctccacggcaacattggcgtaggccatgttcgttattcgactgcgggcagcagtacgagggaaaatgcccagccgcttgtactcaattacttaaaagggaccctggccatggctcataacggcaatctggtcaatgcaccggagctgagacgtgagcttgaatataacggagccatatttcagacgaccattgatacagaggtgatcgcttatcacattgcccgggaaagggtaaatgctgccacagtcgaagctgcagtggcaaatgccatgaaaaagatcaagggggcttattcccttgttattatgagcccgcgtaaaatgattggagccagggatccttttggatttaagccgctgtgcattggaaaacgtgataatgcttatattctggtatcggaaagctgtgcccttgataccattggcgcagaatttatacgggatgtccgcccgggagagatcgtgaccataacaaaggcgggaattgtttctgatacaagcctctgtcctgaggacaaatcaaaggaagccaggtgtatttttgaatatatatattttgcaaggccggacagtgtctttgacggtgtcagcgtctatcactccaggatgtgtgccggacgcgctttggcaatggattctccggtggaagcggatcttgtggttggagtaccggaatcaggaaatgcagcagcactggggtattcccttcagtccgggattccttatgggactgcctttgtaaagaattcctatgttggcaggacattcattaaaccaaagcagagcaaccgggaatcatcggtcaggattaagctcaatgtgctgaaagaagctgtgatgggaaagcgtgtcattatgatcgacgattccattgtcagaggaaccaccagcgcccttattgtcaacatgcttcgggaagcaggggcaaaggaggttcatgtgaggatcagttcccctccgtttctccatccctgctattttgggaccgacatacccaacgaggaacagctgatcgcacataacaggaccattgaggaaatccggattattctgggagcggattctttatcttacttaaggactgaccggctggaagaaatggcagaagggcttcccatctgcaacgcctgtttcagcggaaattatcccatagaaccgccaaaagaggatatccggggagagtacagcgagtaaaaagtttattatcagagccgggaccgccgggctggccacagttgaacaggcccgcaggcggttcctgctttctcttttcatgacacaaaaaatatgctattatgaagataaataaaaaccctaaggaggaatattgagaacatgacagatagataccaaagcccgctgtctgagcgctatgccagtaaggagatgcagtacatcttttctccggacagaaaatttaagacatggagaaagctgtgggtcgccctggcggaagtggaaaaggaactgggacttcctattacagaggagcagatagaggaattaaaagcctatcaggatgagatcaattacgatgtggcggtacagagggaaaaagaggtccgccatgatgtcatgtctcatgtatatgcatacggcgtccagtgtccgaaggccaagggaattatccatctaggagcaacctcctgttatgtgggagataatacggatcttattatcatgaggtcagcactgaaactggttcgaagaaaactcatcaatgtgatcgatgaactggctaagtttgctgacgcatataaggacttacccaccctggctttcacccatttccagcctgcccagcctacaactgtgggaaaaagagccaccctatggcttcacgatctgaccatggatttagaagacttagactatatgatcggttccattcagcttcttggctccaagggcaccacagggacgcaggccagcttcctggaactgtttgacggagatatggacaaggtgagaagggcggatgccatgatcgcggagaaactgggtttttccggctgctatccggtttccggccagacctattccagaaaggtggacagccgagtggtcaatgtgctggcaggcattgctcagagcgctcataaattttccaatgatatccgccttcttcagcacttaaaagaagtggaagagccctttgaaaaaagtcagatcggttcttctgccatggcttacaaacgcaatcccatgagaagcgaacggatggcttccctttccaattatgttatggcagatgtgatgaaccccatgctggtttcttccacccagtggtttgagagaactctggatgattctgccaataagcgcttaagtattccggaaggttttctggcaatcgacggaattctggacctttatttaaatgtcgtggatgggcttgtagtatatcccaaggtcattgagaagcacatgatggctgagctgcctttcatggctacggaaaacatcatgatggatgcggtaaaggcaggcggagacaggcaggagcttcatgaacggatcagggaactgtccatggaagcaggccggaatgtgaaggtcaatggccttgacaacaatttactggagcttatcgcagccgacccatcctttaatctttccctggaggacttaaaaaagagcatggatcccaaacgatatgttggctgtgcccctgcccaggtgacagcttatttagatgaggtggtaaccccccttcttgatgaaaacagggagcttcttgggctgaaggcagagattcacgtataaaaagcttacaggcagacatcagggattttatgaagtctgcctgtgtttttctcgatttttcatatcaggagggatccatgagcagcaatttggaatattacaaggtattttattatgtcgcccagcttgaaagcattacccttgcggcagagaagctgtgtatttcccagccggcagtgagccaggcggtaagacagctggaaaaatccatggacagtcagctttttttgcggacttccaaaggggtccgtctgacacgggagggagaatttttctacaaatatgtaaaatccggtttagaaaatatctggcgtggggaaagtatgttaaacaggctgaaggatttggatacaggcgaggtgtgcatcggggccagtgatatgacccttcagttttatcttctgccgtatctggagaaattccatgagctgtatcctggtatcaaggtgagagtttccaacgggccgacacctgaaacgctgcggtatttatacgacggcaaaatcgatttcggggtagtcagcactccttttgaagcaaagagcgaggtcaagcggaccgatgtaaaggaaatcaggaacgtctttgtggcaggggataagttccgctatttaaaggatcaggaactggattatgagattttaaaggatctgccctgcatttttctcgaaaaaaacaccagcaccaggacattcatggatgagtatctggcaggccacggtatagcggtggaaccggagtttgagctttccaccagtgatatgatcgtccagtttgccatgcggaatctgggaataggctgcgtgatgtcagggtttgcacagatggagctggaaaagggaaatcttgtggagttgaagttccgggacgaaatgccgaaacgccattttaccattgtcactgacagcaaaacgcccgtatccccggccgggaagcgcctgttgcagctgatgacaagtaatataatttgagattatgccaaacataaataatattgattttacttatggacgatcttgcgctatcataagtaagtaaatggtatttttcactcgaaggaggaacattcaaatggtaagagcaatcgtaggcgccaactggggcgacgaaggaaaaggcaagatcacggatatgctggcaaaggaatcggatattatcatccgttaccagggaggcagcaatgccgggcataccatcattaacaactatggcaaattcgcccttcatcttctgccctccggtgtattctataatcatacaaccagcatcatcggcaatggtgtggcattaaatatcccgtttctggtaaaggaaattgaggatctcgtaagcaagggcgttccaaagcctgatgttctggtttcagaccgtgcccagatcctgatgccgtaccacattctgtttgaccagtatgaggaagagcgcctgggcaaaaagtcctttggttccacaaaatcagggattgctccattttattcagataaatatgcaaagatcggatttcaggtcagcgagctttttgatgaagaatctttaaaagagaaggtggaacgggtttgtgaaacaaagaatgttttgatggaacacctttatcacaagccgtccattgacccggcagagctatttaagactctgcaggaataccgtgaaatggtgaagccttatgtatgcgatgtatccaaataccttcatgaggccataaaagcaggcaagaacattcttttggaaggccagctgggctctttaaaggatcctgaccacggtatttatcccatggttacctcttcctctactctggcggcatacggtgccatcggcgcaggaattccgccctatgagatcaggaatattaccaccgttgtaaaagcttattccagtgcagtaggggctggtgcgtttgtcagtgaaatattcggagatgaagcggacgagttaagacggcgcggaggcgacggcggcgaatacggcgcaaccaccggaaggccaagacgtatgggctggtttgatgcggttgcatccaggtatggctgccgtatccagggttctacggaggttgccctcaccgttcttgacgtgctgggataccttgatgagcttcatatatgtgtaggctatgagatcgacggaaaggttacaaaggacttccctacgaccatagagcttaacagggcaaaaccggtatacaccacccttcctggctggaaatgtgagatccggggaattaagacctatgaagatcttccggaaaactgcaggaattatatagaattcattgaaaaagaaatggaaacaccgattaccatggtttccaacggaccgggaagagacgaaatcatttaccgcagataatctgacggggaactataaaaatggagaacaaggaaaagagcgcctgctttttttctgttctccgttttttattatgagccgcggccctgctgagcaagaaaagtgtggaaccatgtggttttaaatcgtcccgatcaaaccgcttttgatgaaaatataaacacctagtccaatgaaaatgattggcacggcagcatgcttatgcttttgtattgcggccgttattctgggaaaatcagtaatggtactgcccaataagcaccataatgccatcataagaaaaaatacggtcatagtcacaacgatctgcatgatggagtatccggtgaagagagggatatatacgcctatgttatccgctccatttgaaacagcaacaaccacaacgctaaatatctcaggattaactgcatggaatatcgcgcactttgcttttattaatacatattgcagtctgctatattccttaccgggtgataatgaaatattctttatctgctcctcattgattgtttctgctttcctgtcaatcccgtggcattgagctgcagggaggcgttttttgattttataattgatccattccctgactcctaaagctatggggagcagtccaagaaagccgatatattcttgcggaacaaagttcaagccgaaagcacctaatatactgatcaaaaccaaaacagcaagtcccagatattgtccaatgacaatatgcttcttttttagtttttcatctacctgagcataaagcagcatcattacaaagatattatctatattcgtgctgacaaaagagatgacagatgctgcaactgtaccggtcatgattgcttattgcttcctgaaggatccgggtcagttttgtccggcttaagcacacgggcgaccagctgaacagcataaagaagaataggaataaccgcagatgaaataatagcggccataagccagttttttgattccgggctatgggaaaaggctgatataagggcaatggcgtacatggcgagaatgagcaacagtccggccatggccaggaaacgtttccatttcacgggaattacctcgctttctgaacatgtttattttttactattatagcctataaaaagaaaaataggaagaagagctttttgttcataaaaactttaaatttgaaacctgtacttttccttggaaatatagtaatattttaaatataaaaaacggaaggcctggaaggagtgcaaaactcttgaggaaacgatggatagcggcagcaggtattattctcaccctgggaagcatgatgacttctatggcagcagaagagatgatacaggaagaaagcgaaagccagcaggcggcattatcggactggcagtggcaggaggagcccgacggctggagatacgtcaatgccgcgggagaacttaaaaaaaactgctgggaagaaatcaacggatattggtattactttaaccatgaaggatatatggcttctgattggacaaggatcagcgggatgaattactgcttttccgagacaggggagctgatacttggctggtgttataacgacgaggaagagaaatggcattattataaggaagatggcacagcccagaggggtggtaccaggagacagacggaagctggtactggttttccataaaaggagagatggcggcttccggctataagactatatcagggaaacggtattatttctttgataatggacagatggcggccaatcagtacgttggccttttctatatggacgaaagcggccagagaaacaaagaattcgatatcaccattgacggaaagaaaacttcctcttctttgtcttctgaggtgagggatgtctttacggaggcaaccaagaacatcccaagagattggataaagaagtttattgatcaggggtgggagatcatctattatcccggaaaacggtatttttctgctccaatgacagaaagcggtatttattatgtgtgccataaactggataccaattataaaaaaataaaaatatgcctgccggaagatttaacagcagcttttggagaatatatcggttatgcctccggctgctacggcagttccagccaggatgccacggatctgctcatgagcagggtttcggtggaggatttcgtggatataccggattatttttcagatgacatgatgttttattttggaaagctggtgtcagcttatgtggagagttcttctaccagagaagagatggaagaggaggcgccccaggtaacggagattttaaagagaatattgtatgccgggtaaggcagattaaaaaatggaaggctgtcccaagacagctttccattttttgaccctttattccgccagctcttcccacagctcataaagttcttccagccgcagcctgatggtttctttctctttattaagttccatcagctttgagacatcggtaaaaatctcttcttttcccagagcttcatcgatttctccatcccttgtttctaattggtggatttcatcctctgttttctttagatcattctggcgcttgcgaaggcgggcctgttcttccttttgcgttttccagtccagctttgtctcggaagtctcttcctgggaaacggcctttacggaagaaggaggagcagcatacaaattcgtcatgatctctttcttttccagatagtagtcgtaatttccgatataattgaccagggtctggttggttaaatccaggattctggtagcagttttgttgatgaaataacggtcatgggacacgtacagaatggtcccggtataattgaccagggcatcctctaaaatttcctttgaagtaatatccaaatggttggttggttcgtccagaatgaggaagttggcttcggaaagcatcagctttgctaaggataccctgccccgttccccgccgcttaaatcctttacccgcttaaatacatcgtctctggtgaatagaaaggctgccaggatgttacggatctgtgtgttgttcatggaaggatacgtatcctgcaattcgtcaaacagtgttttttccatgtgaagcacctggtgctcctggtcataatagccgatatgtaccttggagcctaaggcgatttctccttcatccggttctaaaataccgttcaatatttttagtatggtggtctttccggttccgttgccaccaatgatagctatccgttccccgcgttttacctcaaaattaatgtcatcaaaaagcaggttctgttcaaatgcttttttcagcccacggacggtgagaacatcgttcccactgatgatattgggctccagtcggatccgcatttcatcgtttatttccgatggtttttccagcatttcaattttatccagcatcttttcccggctttccgccctccggatggatttttccctgttaaaggactttaatttggcaatgacctcttcctgatgcctgatttcctgctgctggtttatatatgctttcatctgggcttcccgtatcatagcccgctttccgctgtaatcggtgtaatttccctgatatacggtcataaggccgttatccagttcaatgatctttgtgaccacccggttcagaaaataacggtcatgggcaacgatgataacgctgccgtcataattgagcagatatccttccagccaggcaatggactccatatccaggtggttggttggctcgtccaggaggataatatccggtttggtgaggagaaggcggcccaaggacacccgagtcttctggcccccggatagtgctgtgacaggtttatgaaattcctcttccgtaaatcccaggccttttaacactcctgttacttcactttcataggcatagccgtttaacagctcaaattcatggtttaaccggctgtaggcggcgagcatggactcaagctcatctccggctgcatgcttcatatctacctcaagccggcggatccgcgcctccatatccataataggccgtttggtttccagaacctcctcataaacggtccgctctccggacaggtcctggtgctgcgccaaataaccgatggattttcccttggaaaccaccacatctccttcatctgcgggaagctctccgatgatgatctttaaaagagtggattttccggcgccgttgatcccgacaattgccgctttttcatggtcttctatatgaaaggaagcgtgcttgatcacctcattgcttccaaatgctttgcttatattactgcatgacaaaatcatgtctcgtttcctctttcctgcctgtttttcagggcataaaggtatacccgaagggtacaaaggtataccgaaaggcgttctctccctgtataaatgtaaggcaacagaactagtataatataggtccttgcttttttcaaggatacaatcacaaaacccgtttgacattattttgtcatgcagttataatgatcttagtttaattataagttaaagaaggtgaagaagtgtcagagagagaaatttccaaagcagtgattaccaggcttccgagatattaccggtatctgggcgagttaatggaagatggagtggaacgtatttcctccaatgagttaagcaacagaatgaaagtgaccgcttcccaaatccgccaggatttgaataatttcggcgggttcggccagcagggttatggctataatgtaaaatatttatatgcagagatcgggaagatactgggaattgacaggcagcataatatcgttatcataggcgctggaaatttaggtcaggcaattgccaattatgcaaattttgaaaaacgtggcttcctcattaaaggaatgtttgatatcaatccacggctgatcggccttgtggtccgtggaattgagatccgcagcgtagatgatctggagcagtttgtaaaggacaatgatgttcagattgctgctctgaccattccaaagacaaaggcaccggagattgcggaccgccttgtaaaggcagggatcaaggcgatctggaattttgctcatacggatcttagcgtgcccgatgatgtggtggtggaaaatgtccacttatcggaaagcctgatgcggctgtcttaccgggtctgtaacatgcaggatcagaacgaggaagaaaaaaacaagcaagctgaaaaaaaggggtaacatgcctgccggcaggtgaaggggagacttttcgctgccggtagtttttctatgacaaggtttaaggaaacaccctacgggtatacctttacacccgatggagcggggtggaccctgcccagaaagcatgggctataataaggaaaggcgggagaaatatgagatatctggtaacaggaggacagatgaaggaggtggaccgctataccatagagaaggtggggatcccctctctggtgcttatggaacgggcagccctggcggttacagaagaagtagtaaaatacgggaaaaagacggaccggatatgggtcttatgcggaaacggcaataacggggcggacggagtcgcagctgccagaatgctgcatttaaaaggatatgcagtgtcagccttgcttgcaggaggaagggaaaagggaagcggtgaatatcttactcaggtttccattgcagagcatacgggcgtccatctggtggaattccctgattttaaacccggctccatccatattctcattgacgcgctttttggcgtggggctggaccgggagatccttggtaaataccgggaaatcattgaggcagtttttttctacaggccggaatttacggtggcagtggatattccctcaggcattcattccgatacgggacaggtcatgggcattgccttaaaggcggatgtgaccgtcacctttggctatgaaaagctggggaccatgctgtatcccggaaaagaatacggcggaaaggttcttgtggctgacatcggttttccgggcaaaagcctggaacgccttaaaccggaattttttactctggatccaggggatgaggaacagctccctaaacgcccggcttattccaataaagggacctttggaaaggtccttgttgtggctggatcgaaaaacatgagcggagccgcttatttaagcgcccttgccgcttaccggacaggggcagggctggtgaagatttttactgtagaggaaaacaggaccatcctccagacagggcttccggaagccatcatcaccacctacgacgcaaaagaggcagaggcatgtacggcaggatttaaagagctgctggtaaagcagtgtgagtgggccaccgcaattgttctggggcctgggcttgggcaggaagtctatgtgaggaatttggtggaggaagtccttgcaaatgcatatgttcccattattctggatgcagatggcctgggagccatcgcttcaaacccggaactaaccagctatttcacggaaaacatcattgtgacgcctcacttaggagagatggcaaggctaaccggcagttctgtgggaaccataaggaaaaacttggtggcaactgccagggaatatgcggaccggttcggcatcacctgtgtgctgaaggatgcggcgaccattggagcgttaaaggatcagaggacctatatcaatggaagcggcaacagcgccatggcaaaagccggttcaggagatgtgctgacagggattatagccgggcttctggcccttggcttagaagagtcggatgcagcggcttttggcatatggcttcatggccgtacaggagacatggtaagagagaaacagggagatcacagtcttcttgccagggagctggcagaagagatacattcaatatggcagggacaaacgaggtaacagagagatgaaattatacagcagagtttatgagacagtggatttggatgccattgggcacaacatggaagccatgaaggcaaatttaaaggaagggaccaggatgatcggtgttgtgaaatccgacggatacggccacggagcggttcccatagcctgggccatagatccttatgtgtggggatatgcggtggcgaccgtggaggaaggcgtgatcttaagaaaacacgggatcaaaaagcccattctggtcctgggcgtagtgcccttggatggatacggccttttggtggaaaatgaaatcagctctgcggtatttcagctgaaacgggcggaacgcctttcctgtctggcagaaaaggaaggaaaaaaagcagtcgtccatctggtagtggatacgggcatgagccggatcggatatccggtaacagaggcagcggcggatgaggctgcaaaaatctgcagccttccgggaattgcagtggaagggctgttcactcatttcgcaaaggcggatgaaaggaataaggaagccacagataaacagattgaaaagtacgaaaagttcgtgacaatgctcactgagagagggatcaccattcctatccttcactgctccaacagcgccgggatcctggatgtgcagaaggccaactttcatgcggtacgggcaggaatatccctttacggcatttatccctcggaggaagttgacaggaacacggtaaagctggagcctgctatggaattaaaaagctttatctcctatgtgaaaaccattgagccgggaacttccgtaagctatggaggaacctttactgctgaccgggaaatgacggtcgctactattcccgttggatacggtgacggctatccaagaaacctttccggaaaaggggaagtgcttatcaggggacagcgggctaagatcctggggagggtctgtatggatcagtttatggtggatgtgaccggaattcatggagcagaggaagaggatgaggtggttttaatcggcaggcagggaaatgaagagattacggtagaagagctggccagggtaggcggcggcttccactatgagatcgtctgcgatatcggcaagcgggtgccccgcatttacatagaaaagggccgggtcattggcacgaaagattatttcaatgattcttatgaagggttttgcagggtctgataacaaactccatgtccaaaacatatgataaggtatgcggcggaaaaacttaagtgaatacacgagtcaaagaaggtcaatactagacttaggcgtgatttgttaattgaagcaagggttgtacagccaaaattcagcaaatcagccgttcggtgagctttaaggcgaatcgagcttcctaaataattgacggagtgtgagagtgtgataatcagacgtggagacatttattatgccgatctaaggccggtggtaggctctgaacagggtggtatccgtccggttcttattatacaaaacgatataggtaataagcacagccctaccgtaatctgtgcggcaattacctcaagaatgaacaaggcaaagcttcctacccatgtggagctggatacaaaaaaatgcgatatgatcaaggattcggtgattcttttagagcagcttcgcaccattgataagcagaggctgaaggaaaagatctgtcatattgatgacgagcttcaacaggaagtggactgtgcattaagggtgagcctggaactggatacatagttcaccaaatcgaactttcttgacggattactgagaagatggtatatttctaaatagttacgagaaaaaaatacgaatgataatggacaaaaggagtagatttttagaatggacgatggcaatccgcttttacgcgtgattatttttattgcttttatcgtgctggacgcaatattctatgggtttggagcggcgatccaaaacgtgaatacaagcgaactggagcatcagatggaggagggtagtaaaaaagccggtcagctgttacatattgtaaacaggcctaccaggtttgtaaatactatccagatcaccactaatttaataggcatggtaacaggagcttttgttttggaacagctgggagcaaggctggagacggttctctccagaggcagggtttatcccagccagtgggtatccttaatcagtcttctgctggtttccgcgctgctgattgtgcttttgatcagttttggcatcattattccaaaacgatgtgcggcggaaaatcctgaaaaatggggctatcggatgctgcctgcagtatccctcatcatgattcccctcctcccatttacctggctggcaaatatggtggcatacttcgttttaaagcttatgggaatcgatatggcatcagataatgagaacgttacagaagaggacatcatgtccatggtgaacgaaggccatgaacagggcgttttagaggccagggaagcggagatgatcacaaatatctttgagttgaatgataaggaagccggagatattatgactcaccggaagaacctggtggctttggacggagagatcactctccgggaggcagtgaattttatactgaaagagggatttaattcccgctacccggtttttaaaaaggatgtagatgacattattgggatccttcatatgaaggatgctttgattgctgtggaaaataaacggaatgcatcccgccagctgtgtgaaatcgaagggttgttaagagaggctcatttcattccggaaaccaggaacattgataccctgtttaaggaaatgcaatccagaaagattcatatggtgatcgtggtagatgaatacggccagacggcgggcattgtgacgatggaagatattttggaagaaatcgtgggcaatatcatggatgaatatgatgtggatgaagaatacattgtcccttctgaggatggctcctatgtggtaagcggcatgaccccctggaagaagtggaaaagaccttaaacattgagtttgatgaggaggattatgactcctatgatacggtcaatggtttattgatttcaaggctggaccggattccccaggaaggggaggaaacggaggtgtccattctgggataccgtttcaaaatccttcgtgtggagaataagatcattcacaccatccgggtctggaaggaagaaccggaagagaagcaggaggaagatccggagcttaggaaaatggaggccaatgaggaatccttagtagaaaaagtgtaaaatcagcacagctgcctgcgctccctgtcaaataaagggagaatcggcggctgtgtattattttttcttgcaagatgaaaaaaatagtgctaaaataggaaagatgttgatttttaaagatcatatggacgaagtagagaaagaaaaggagtgttggaaacaatgtcaggacattcaaagttcgcaaatattaaacacaaaaaagaaagaaacgatgctgcaaaaggcaaggttttcactatcatcggaagagaattggcggtagcggtgaaagaaggcggaccagatcctgcaaacaacagtaggctccgcgatattatcgcaaaggcaaaggccaacaatatgcccaacgataccattgaccgcggcattaaaaaagcagccggcgatgcaggctccgtcaattatgaaaccattacatacgaaggatacggccctaatggggttgcaatcatcgtagacacgctgacagacaacaagaaccggactgcagcaaacgtaagaaacgcatttaccaaaggcggcggcaatgtgggaactcccggctgtgtgtcctttatgtttgataaaaaaggccagatcatcattgataaagaagaatgtgagatggatcctgatgagctgatgatgatttctctggaggcgggcgcagaagatttttctgaggaagaggacagctttgaggtaattaccggacctgaggaattcagcggagtgcgtgaggcactggaagcagcaggcattcccatggtggaagcaggcatcaccatgatcccccagacatgggtggaactgacggatgaggattccatcaaaaagatgaaccggattatggatcttcttgatgtggaggacgacgtacaggccacttatcataactgggatgaataaatagacgataaaagtgaggaaagagctttgcagcaggctttcctcactttttttagttgatttccgttaaattccttacggcatcttctatttctttaacaagttcatggatcctttgatagacggatcctgaattctttgaaatatctccgaattctctggctaccacggcaaagcccacccctgcttcccctgccctggcggcttcgatggaggcattgatggacagaatgctttccatggaagcgactttctggagatcgtgagtcttgtttgttacctcacttaaggaattctgaattttgcttatctccgaatcaaaaatatcatttcttttctgggtaatggtttttatatattccagattagccagctggtttataacgttccccagcatttgcgcagaagcccggatcatgcgttcggactgtactgggtccgtctgaaactcctcaccacaggagtctttcttagactcctttggaagcccgccgatgatggctcccgccttctccccgtttatgataatgtctgtggaaaaatctgtggggtttgtatgggaggaaccggaaaaaccacttccctttgttatgtaattcccttctgcatccaccacaacggccgctaagccggtggattcgtaaaattgatcctggattttctgtaaggcgcttaggtcaaggaactttttgatatcaatcatactcattttgccgccctttctgtagtaaagtgctgtacaatttttatatataatattatataataatgaagggggaattacaagcagctacttaaacgaaagagaagagaaatggatgcacatcatgaaaaatggtacggagttaaaaaaatggaagaggattgagattatggaaagcggtcgattgtaccgggtacaaaaagaagatgtggaaaaattaaaggaattgctgacggaatgctttgcaggggacccgctttactgcagactgattcctgacggaaagaccaggagccgtttgctcccggaattatttgaatgtgatatggaagaatttttgagacttgtgaaatatatgccgacagcccggaaatcaacgggatccttgtggtggatgacgaatcccagccttataatgcctttcattattatctggcggaagctgccgccctgttaaaaacagacggttatctgataaaggaggatccttcctttaagacattctggaatttcttccagggaagagattatttaaattccagatggacggaccagcttgaccaggaaaaacggctgcacatcatttatctggcagtgcggccggccatgcagcatcatggaatatcgtccctcctgttaagggaggcaataaactatgcggatgagaatcagctcatgatttccttagaaacacacaatgaaagtaatgtatcattctatgagcatttcggttttaaggttttctgcattgtggaaaagcgtttccggttaaaacagtactgcatggtccgggaaataaaatagggtttaatatatataataggacaggctttctgtaatctgaaagcctgcctttttatataatgccatggcaggcaggttttggccggacacctgaagaaaaagctttttaggtttttccggtcccggcagtgaaaaacaggtttccagaagcagaaaaaggcaggcacttcccagaccatggttccgtaaattctctgcaatttcaaatccgtaaaaataggcggactgtccccggaaatcaagataacaggagccgacagagctgccattcatcagaaacgtacatcgggagggaccttcttccggatcatgggcaatggataaggaaagggactcagcaaggcagttgctctttgccggaccggtttcagaaaaaacggaggcagtaagctccattaagtgctcctgataccagaggaccgctcctaatgcgtcaagggtcctgaccgtgtcttcagaagtttcatccacaggaaagaccagatcaatgtccccggattcctttaaaagttcttctaaaagcagggcaaaatgtcccttccgcctgtttgccggaagggtgcaggcataacattcatattccccgttttcattaaaaaaagcggaaagagcggataagaggctgtcttcgtcgtataataagtaaaaagtacagtcttcttccatgggaaaggagagggaaatatggtcatgctttctgcaggtttcctgcaggcggagcaggctgtttttctgggtattgctgggggtttttgttcgtatgatattcatggcaggactcctgttcgttttcataatgtagtctatctgaactcgcagcgcaaatgaagataaaagagctgccttttagcccgttcatcctattatcgaaagcgtttttgcatccgataatataatacaataaaaaaatgtgaaaattcaataaaatattttccatattgctgattgtctctttgaaatatgggtgatagaataaacacaagtgaagcagttggagggatctatttgaaaaagagagaagaaataccggtttgcgatacctggaacttggcggatattctgccgtctgagagtgcatgggaggatttattccgtgaaacagaaagctcgctttcaggttataagcgttacgagggacatctggccgactcaggcaagatgcttttttcctgtctgaaatttgacgaggagatatccctgaaaattgaaactctgtttgtttacgggaaacagaaatccgatgaggatacgggcaatgccagatatcaggagttttcctccaaggcaagatccctttcctatcaggcggccgggctgtcatcatttttggtgccggaaatcttaagtctgccggaagagacccttgctaagtaccggaaggacaccccggaactgaagcgttatgacaggactcttgagatcatcttaaagaagaaagcccatactctgtcagctccgatggaagctctgctggcaaagtccatggaagcgacctccggcccttcggagatctttaatatgtttaacaatgctgatgtgaaattccctgaaatcatggatgaaaagaatcagccggtcaggattacccatggaaattatattgccctcatggaaaagcaggacagaagggtgaggaaatccgcgtttgaagccctgtacagcgtttatgggcagtttgtcaataccctggcaagtactttttcgtccaatgtaaaacaggcggctttttacgccaaggcaagaaattacccttctgcaagagcccattctcttggagagaatgaaattccggaagaggtgtatgacaatcttataaaagcagttcatgaaggccttcccagcctccatgagtatatatccatcagaaaaaaggctcttaaagtggatgaacttcatatgtatgacctttatgtgcccatggtttcaagggaagaacacaaaatcacctttgaagaagccaaggccatggtgctggaaggccttaagcctcttggggaagaatatttgtctcttttaaaggagggctttgacaaccggtggatcgatgtatatgagaatgaaggaaagcggagcggcgcttattcctggggagtttacgggatccatccttatgtgcttttaaactttaacgggacacttgacagcgttttcaccctggctcatgagatggggcatgcccttcacagctggttttccgataaaaaccagacctatattgacgcaggatataagatctttgtggcagaggtggcttctacctgtaatgaggcgctgctcatccggcatttattggaaaaaacagaagataagaaggaacgggcttaccttgttaatcattttatggacagtttccggggaactctttaccggcaggccatgtttgctgaatttgaggcagaggctcattgccgcgcaggggaaggcgaagtgctcaccggggaagtcctttgcaggatatatcacaggctgaatgaggaatattttggtccggatatggtggttgattcggaaatcggttatgaatggtccaggatcccgcatttttacacacctttttatgtataccaatatgccaccgggttttcggctgccattgccatcagcagcagaattcttacgggggatgaaaatgcggtcaaaggttattatgaatttttaagcggcggaaattccatgacgcccatagaccttttaaagctgtgcggcgttgatatggggacggcggagccggtgaaggatgcgctgtcagtatttgccgggcttttggaggaaatgagccggcttatttaagctgattgttggatagaggagaggggagcaggtatgaatctgtatcagatgatatttaaaagaagatcgatcaggaaatttaagaaggagccggtcccggaacagctgttaaaggacatcctttatttcggtgataatataccaaggctgcacggggatattcagatcaaaatggagataagtgaaaatccggattaccacctgcctgttaaggggctgtggaaagtggaagcaccttattatctggcattttactccgaggaaaaggaggggtacctggcaaacgcgggatatgtgctggagcatgtgcttttgtatatgacaggtaaggggcttggaacctgttatctggggagcacaaaggtcccggagcctgtccctgcagggatgaagcgggtgatcgtagtggctttcggctatcctaaaaccctgctttaccgtgacccggcgacggccaagcggcttcctttaaaggaattatgtgtgtttaaggaagaagcaggagaatccatgaagaatatactaaaggctgtccgccttgctccgtcggctatcaatacccagccctggcgttttatcgtttatcatgacaggatctatattttttcctgcagggaattcctgccctcatcttcccttgttgccatgcgggagataggtacagggatcatgctttcccatttgaccattgctgcggaggaaatgtggatgaatgtaaagctggaagcagagaaggccatggagaaaaagtcttataaaagcggtgcatatgtgactacggcatttttaaaagagtataaatgctgatcagcttctttaactggtacagacaaaaagggaagaccctctgtttagggccttccctttttgtccgtaccggtttgatttattcaatggcgatatagcggttttcctcgatctgctttggcgcttcttttggaaataccagctttaagattccgttttcaaaggctgccttcacatcttcctgtttcaggccggaccctacgtagaagcttcttttcacagagccgctgtaacgttcccttcggatataatttttctgatccttcacctcgttttcagaaacagtttccgcgtaaatggtcagatacccgtctttcaattcggcccgaacatcttcttttttatagcccggaagctcaatttcaatgacatagttggttccgtcgtcttcaatgtcagtcttcatcagggactgtctgttgtgataggtatccgtaaaaaacggatcattgaaaaattcatcaaataagttgtttcttctggctaataacataaagagttcctccttttttaagtaatttatttgccatcggcttttccgatggatttctacttgttatacatgtaatataacacacattgttagcactgtcaataggtgagtgctaatttttttgagaaaaagaaacgaatcattattgaatgtaggttcaagagatggtagaatatccatgtttgttaagaaaaaagctgagaaaacactctgcaggtatacctttatgcccaaggagtatgggcggaaatgaggaaaatcattcatgaaacgggaaatcgattggaaagagatctcagatggaaaattatatggcttaaatgatatggtaagggcggattgcggcgactgcaaaggctgttcgtcctgctgccaggggatggggcagtcagtcatcctggatccccttgactgcttccggctgacagaaaatcttcattgtactttggaggcactgctggcggacaagctggaactccatgtggtggatgggatcgtgcttcccaatctgaaaatgggaggaaaagaagaaaagtgcgggtttctggaccatgaagggcgatgcgggatccacagcttccgtccaggcgtctgccgcctgttcctttaggacggatttatggagaagaggggttccggtattttctccagatccatgaatgcagtatggaaaacagggcaaaggtcaaggtgcgcaaatggattgatacccctgatgtaaaacggtatgaaacgtttgtgtgtgactggcattttttcctgaaacggctggaagggaaaatggaagaaaataaggaccagtcttatgcaaatcaagtcagcatgtacgttttaaaacagttttatcttacaccctatgacaggggccaggattttttcgatcagtttggcaaaaggcttgaagccggttccttcttatgatagaattggtaagaatagagaaaaataagggcgaagagatccaaggaggaaactatgatcaggcagttaatagacaaaattcaaaaaacaaaggcaccgatctgtgtaggtttggaccccatgttaaactatataccggagcacattacgaaaaaggcatttgaagaattcggtgaaaccttagaaggtgctgcggaagctatctggcagttcaataaagaaatcgtagatcatgtatatgatctgatcccatccgtaaagcctcagatcgccatgtacgaacagtttggcatcgaaggcctgaaagcgtatacaaagactgtgaactattgccaggaaaaggggcttttcgtcattggagatgctaagagaggagatattggttccacatcagccgcttatgctatggcacacatcggccatgtgaaggttggaaacaaaagcttttctgctttcggtacagatttccttacggtcaatccatatttagggaccgatggcgtaaagccctttgtggatgtgtgcaaggaagaggacaagggccttttcgttctggtgaaaacctccaatccttccagcggcgaatttcaggacaggcaaatcgacggaagacccctgtacgagctggttgcggaaaaggtggttgaatggggagcagactgcatggatggcgattacagcaatgtgggagctgttgtgggagccacctacccggagatgagcagaattcttcgtaagcttatgcccagcacctatttcctggtgcctggatacggcgcccagggaggaacagcagaggatttaaagccttgctttaataaagatggcttaggagccattgtaaactcctcaagaggaatcattgcggcctataaatctgaaaactacgcccggtttggcggggagcatttcggcgaagcttccaggcaggcggtcattgacatggtttccgatattaacagggtattataggggagaagcaatggcaaaagttaaggaaaacgcagtggttgcaagccagacatggcttggcgacgatgtatacagtatgtggatcgagacaaaagaaattactgcccaggcagcgccgggacagtttgttgacttatatacaaaggatggagcaaagcttatgccccgtccaatcagcatttgcgagattgataaggaaaagggtcttttaaggctggtataccgggtcgttggagggggaacggaagagttttcccattacaaggcaggggacaccattgagatcctggggcccttgggcaatggatttccactggaagcaggagaaaaaggaaaaaaagcctttttgatcggcgggggaatcggaattcctcccatgctggagctggcaaagcaattgccttgtgagaagcaggtggttcttggataccgggatgctttgtttttaaacgaggagttccgcccctatggggatacctatattgctactgaggatggaagcgccggaacaaaaggaaatgtcctggacgccatccgggagaatggcttacagggagatgtgatctttgcctgcggcccaactccaatgctgaaggcgctgaaggcttatgcttttgaaaatggaatggagtgttatctttctctggaggagaagatggcctgcggcattggagcctgtcttgcctgtgtctgtaaaagttcccaggtagatgaacattccatggtccacaacaagcgtatctgcaaggatggtccggtatttaaggccgaggaggtagaattttagatgaatacgaaagtgaatctggccggagtggagcttaagaatccggttatgactgcttccggcacctttggttccggtgaggaatacagcgagatgatcaatttgaatcatttgggcgctgtggttacaaagggtgtggctaatgtgccgtggccgggtaacccaacacccagaatcgcggaaacctacggaggcatgatcaatgccattggccttcagaatccgggaatggaggtcttcattaagagagacattccgtttttaaagcgatacgatacaaaaatcattgtcaatgtctgcggaaagactacagaggattatatccaggtggtggaaagactggcagatgagccggtggatatgctggagatcaacatctcctgccccaatgtaaaagaaggcggaatcgcttttgggcaggatcccaaggcggtggaggccataaccagggaagttaaaaaatatgcaaaacagccggttatcatgaaactgagtccaaacgtgacggatatttgtgtaatggcaaaggcggctgaggccggcggcgcagatgtgctgtctctcatcaataccttaaccggcatgaaaatcgatattaaccgccgcacctttgcggtggctaataaaacaggaggtttatccggcccggccattaagcccattgcagtacgcatggtatatcaggcggccaatgcggtgaagcttcctattatcggcatgggaggaatcatgaatgccgaggatgcagtggaatttattcttgcaggagctacggctgtttccgtgggaacggcgaatttccggaatccttatgcagcggaagaggtagtcaggggcatagaggattatatgaagaaatatcatatagaagatattggggaactgataggcgctgtacggtaatcccatgattttgaatagagaggataaaaagatggaacagtataagcaggaatttattgagtttatggtggacagcaaagtccttaaatttggcgacttcacgctgaaaagcggaagaaagtccccgttttttatgaatgcaggctcttatgtgacgggggcacagcttaaaaagctgggtgagtactatgcaaaggctatccacgataatttcggggatgattttgatgttctgtttgggccggcttataaggggattcctttaagcgttgccacttccatcgcctttcatgagctgtacggaaaggaaataaaatactgctcaaacagaaaagaggagaaggatcacggcggtgatgcaggaattcttcttggaagccccattaaggatggagaccgtgtggtgatcatcgaagatgtgactacctcaggaaaatccattgaagaaaccttccccatcatcaaagcccagggaaatgtggagatcttaggccttatggtttccttaaaccgcatggaaaagggaaaaggagataagggagctttggatgagatccaggaaaagtatgggtttaaagcagccgccatcgtttccatggcagaagtcatcgaacacctgcataacagggagttcgatggaaacgttataattgatgatgccataaaaggggccattgacgcttattatgatatctatggtgtaaaataagccctttcaaggatacctttatgcccaaagagcgtgggcaggaaagaggaaaggagagtttgttatggaaagagtttataagtctatgagaaatataggagccttaaatattgctgttggaattgtggtgaccgtgatcggactagccgctggaaccgtatcaattataaacggagcaattctgttgaagagaaaatctgaaattacattttaactgaatcaggcagcgatagctgctattcggttatgcccggtgaagcggggcagggcctcccccgcattatcggggacgctgtgagcaagtagcgaagcggattgcaaatatctgcttgacctgttatgatcggagaggatgctgttaaaaaggcgaggcttttgaacagcctctctcttttttgcgcgagtaatgagcggaatgaatatgcttgcatattcattgggcgaataccgcggcagctaaagaaaacttcttttccttagctgccgtatatagatggagctgttatgattaaaaatgcgacgaaacggcagaaaatgggttgggtaatcttcatattttacctgatctttttggcatactttttatttttttccgattattttggcagaggcagccatgctcaggcggaatatgcatataatctgaccccgtttaaggaaatacggcgttttatcgtttaccgccatgtggttggaatggagtcctttctgctgaatatcgtaggcaacattgtgggttttatgccctgcggtttctttcttccggtcatcagccgcaggagccgccgctggtttaatacggtgctgctaagctttttgttcagcttatgcatcgagaccatccagcttattttcaaagtgggcagctttgacgtggatgatatgatactgaatacactgggaggtatccttggatacatcctgtataaaatcgttcagcacataagagtaagagttaggaggagaaggcgtgcaaaagcagaaaagagtgtcctacattagaaagccctttgcaaagaggagctttctctccctgggacttgcagttggggcattggcccttggaatcattggaatcgtcagtgccgtgatggcggaaggccaggcgcagcttaatgtggcggcggtctgcttttgcagcctggtgatttcccttttttcactggtttatggtgtcctttctttctttgaaaaggaaaaaaaatacatactgtccaagattggaatagggatcagtgcagccttggtcattctttgggcagttcttatcattataggaataaaggggtaaaaaattatggattatcaggtaatgtttcagcaggaaaatgaaaatattatggaacgctttgagctgtccatggaacggatcggccagattgcatcagaacataccgtacaggagccgtatcatgattattttgccaggacagcagcctttatcagcatggtgggagaatatctccggttccttgagtccggagatcaaaagacggcgcccgtggaggttttaaaggaatggaaccagaagttttatcaggatattttacccggccattatgaggaaagctatgctaatccctcgtatgcagtatcaaagctgggagatggttacggccagcttttatcctatctctataaggagatacggggggacattgtttttgttcacgaatggaggcttacggactttaccattttaaatgaaactcttattgaaatttacaacatgtttgaagagggaatccctcaagtgtccgccattaaggaagtgatctattggtttgtcagcgattatacggatcacacggttactttccgggtaagggaaggccttgatccgaccctttcttttgcagcggatattatccgggaaaatgatttaagggatttgcggtatttgtattattttggagagtatatttccgattcccagttaaagactgcagagttcttaaattctcttccagaggaaacggtgcgccttatggcagatacctatacggaagggtaccgtaaaggctttgaggtaatgggaagggatttagagaaaaagggagcagtacagatccgctatgagctgggctttgagcggatggtaaaatatgccatagagaattttgaaaagcttggccttaaagtaatcctttgccgttcagccatctggacggtcaataccaacgcaggccggaagtccggctattacagcaaatctcccaacaggcagtatgactatgaccatcgttatgatgatgctctttatttaaataaggcatttaaggaccgtaaggcagctgtcttaaaggtagcctatgaaacctacaaagagcaggcggcagcctttgcaggtcctgcggtgattgaaacctttggaaaagaaggttttgagccggtgaataagccggaagccaatcgtctggatgccagacaggaaaagctttcagcggaaatgtccaatgaaacctcaagaattctcaatcagtacgtaccgggagatgagaccagctttaccatcatcgcgtttccggtgccggaaatcggggaagatttcgaaaagatctttgaagagaccattgctatcaacaccctggactatgagaaatataaggcgatccagcaggcggtcattgatgttttagatgaggcggagtacgtggaggtgacgggaaaaggagacaataagactcagcttaaggtagcccttcatccattgaatgataaggataaggaaacaaaatttgaaaactgtgtggctgatgtgaacattcctcttggagaggtgtttacgtccccaaggcttacgggaacggaaggaactctggaggtcagcacggtttatattacggactttcagtttaaagatcttgtcatgacctttgaaaatggcatgataaaggactattcctgcagcaattttaaagatccggaggagggaaaagctctggtaaggcaggttattttaaagaatcatgacacccttcccatgggagagtttgccataggcaccaataccacggcttatgccatggccagaaagttcggtatcattgataaactccccatcctgatcgtagaaaaaatggggcctcatttcgcagtgggcgacacctgctacagctgggcggaggatagtcctgtttataatcccaacggcaaagaaataatcgcaagggataatgaagtatccgcactgagaaaagaggatttatcaaaggcttatttcagctgtcacacggatattaccataccctatgcggagctggataagatagaagctgtaacggcttcgggagagcggattctgatcattgatgacggaagatttgtattaaagggcacggaggaattaaatgttccattatcagaggcctgattgctaaaaatttaaccgaatcaagtaagtccccacttcaaatgcgacaagcattaagcggtggggacttgcttgtgccaggcggagtacaagctctgcctgataagcagcgaagcggattgcagatatccgcttgagaaaaacgaaaaagtatgcaaatattcaacaaattattttaaagtgcttataaaatggaagagcctgccgataagatatacgaaggttaaggttgaaagaataatatctttcaaccttgagtttatgaacagggtgccggctctgcggggcataaactggatatgcagatatatccggttgtttcatcagtatataaaaataggatagataatgtgattggaggacaaaggtgaagaatttaaagataggtaaaagaattggacttgcttttggagctatcctcgtgctgtttttaatagtttccaccatttctgtggtaagcttaagacaaaacaacggtaagtttgtagatttttttaacaacggacatcaggtcgcagttcaggctcttgaaatgagacgtgatatccagtccgcagctaaaaatgtgggatatgcgaccatgagccttgatttacagaccacaggaggttatgtggatgctgcggaggcagatctggaagacttccagaagaggatggagtttttaagagaaaattaccagggggaccaatctctggtggatagcattgaaaataccttaaatgaggctcagccttacaaggaagaagtatttagcctggcaagggaaaacaagaccagacaggctgcggatatattctttgaatcattagacccttatttcaccaaggtgcaggaagacttagtcaaggtcagtgattttgccaatgcaaaagccgatgataattataaggacgctcagacgctggtagggattactctgaccactgtggtggctttgcagatccttgcggtgcttgccaccctgggcttttccattttcaccacaagaggcattgtggctcctgtaaaagagatcgagaaggctgcggaggagatgtcaaggggaagtctccatgtcatgttgaattaccagtcaaaggacgagctgggctctttggctgacagcatgcggaccaccatttccaatattggaaacatgatagacgatatcagcagcatgctgggggcattggcgatcggtgatttccaggtgaactccaagcaccgggaacaatatgtcatggattatgaaccgatccttctggctatgcagtgtatcaggaacaacttaagcgaagcgctttcccgcattaaccagtcggccgatctggtggccaatggttcggagcaggtatcttccggcgcccaggcattgtcccagggagctgcggagcaggcttcttccgtacaggaacttgcagctaccataagcgatatatcaaaccagataaacaccaatgcaaaaaatgcgaaagaggcacgttctacctcagaagaagcagccagaaacgtggcaaagagcaatgagaaaatgtctgaaatgaaccgggccatgacggagatcagcgataaatccaatgaaatcggaaaaatcataaagaccattgaagatattgcattccagaccaatatcctggcactgaatgctgccgttgaagctgcccgcgccggggaagccggaaagggttttgcagttgtggcagatgaagtgcgcaaccttgcaagcaagtcaggggaagcggcaaagaataccacgctgctcattgaggaaagcatgcaggcggtggaaaatggaaccagaatcacttctgagacaacccgggccatgcaggcggttgtggaaggcagccagcgtattaatgcgatcattgaggaaatcgcaatggcttctgatatgcaggcggcggcagttgaccaggtagcgcaaggaattgatcagatatcctgcgtggttcagaccaactcagccacagcagaacagagtgcggcagcaagtgaggaactgtcaggtcaggcacagattatgaagggacttgttgagggctttaagctttatgatggagagctggaagaagagacttccaagtccgcagcagagcccaaagccaggaaatcttcttcggaaatgccggtttacgtggaacacagggaggatccggtccttaccattgatccggtttattttgaagagccttccgcatttggcggcggaaagtattaaccatacatagcaggcggaagggccggagagaatgttacatatctttccggttctcccgccctttttatgctcttgtgaatgagcttaaatttttaaagaaaaccattgactcagcagaaaaaaactagtattataattaataagaaatggttaattaataagcgataattattagcaaaactaataaactgcattactgcaaataatgagtaatcacatcaaacaaaatcaaaaggagaatttactatggcaaaggtatcaattgttatgggaagtgattctgatatgcctgttatggctcaggcggcagatgtattaaaaaaattcggggtggagtttgagatgacagtgatttccgcccatagggaaccggatatatttttcgaatatgccaagacggcggaggcaagaggcgtaaaggttattattgccggtgcggggaaggcagctcatcttcctggaatgtgcgccgccctgtttcccatgcctgtgatcggcattcccatgaagacctctgaccttggaggagtggattctctttattctattgtgcagatgccttccggagttccggttgccacggttgccataggcggcggaaccaatgcagggatccttgcggctaaaattttagcagtgggtgatggagagcttttgggaagactgaaggaatattctgaaaatcttaaaaatgaagtttcagaaaaagcggagaagctggaccagatcggctataaggaatatttatcccagatgaagaagtgagaaaatcggaggcgaggagaaaaaatggattataagaatgccggagtggacattgaagccggatataagtcggtggaattgatgaaaaagcatgtgcaggaaaccatgaggccggaggttctgggagggatcggaggattttcgggagcattttccatgtcagcttttaagaatatggaaaagcccacccttgtatcaggaaccgacggggttggtacaaagctgaagcttgcatttttaatggacaggcatgatactattggcatcgactgcgtggccatgtgcgtcaatgatattgcctgcgcaggcggcgaacccttatttttcctggattatatcgcctgcggcaggaattacccggaaaagatcgcccagattgtaagcggagttgccaatggatgcaaacaggctcatgctgcgttgatcggcggtgagactgcggaaatgccgggattttatccggaagatgaatacgacctggccggttttgcagtaggcgtggtggatgagaaggatcttatcaccggggctgatgtgaaggagggagatgtgctcattggtatggcatcttccggcattcacagcaatggtttttctctggtacgcaaggtatttgacatgacaaaggaaagcctggacacttattatgaggaattgggaaaaactcttggagaggtactgatcgctcctactaggatttatgtagatgcattgaaacgtgtaaagaaaagcggagcagtgatcaaagcctgcagtcacattaccggaggcggtttttacgagaatatcccccgtatgctgccggagggcatccgcgctgttgtggataaagacagttataaagtgcctgccatctttaagctgctggcagaaaaaggcgatattgaggaagaaatcatgtacaatacctataacatgggaatcggaatgattcttgcagtaagcccgtcagatgtggatacagccatggaggcaatccgtgaggcaggagagcttccttatgtgatcggccgtatagaaagaggagagaagggtgtgactttatgctgagagtcggcgtgctggtttccggcggaggaaccaaccttcaggcagttttagatgccatggactgcggaagcatcaccaatgcagagataaaggtggtcatcagcaacaaccggaatgcttatgccctggaaagggccagaaatcatggaattccggctttctgcatttctcccggagattttaaggggagagaggagttttatgaggaacttcttttaaagatagacgaatactgccttgacctgattgttcttgccggatatctggtcacggttccggcggctatgatacaaaagtacaagaaccggatcatcaacgttcatccctcccttatcccggctttttgcggaaaggggtattatgggcttaaggtgcacgaagctgccctggcccggggagtgaaggttactggagcaacagtccactatgttgatgaggggatggatactggtccgattcttttgcagaaggcagttgaagttttaaaaggagatacgccggagtcattgcagcggcgtgtcatggaagaggcagagtggcagatccttccccaggccatacaactgattgcaaacggacaggaggaatcgcgatgaaggtcttgatcataggcggcggcgggcgtgaacatgccattgcatggaagacagcccaaagccctaaggtggataaattatattgtgcccctggaaacgcagggatcggagagattgcggaatgcgttgacatcggagtaatggattttgacaggcaggtggcctttgccagggaaaaggggatcgatctgactattatagggccggatgatcctttggtagcaggagctgtggatgcgtttgaagcagccgggcttcgggtattcggtccccggaaatctgcggctttgctggaaggatccaaatcattttccaaggatctgatgaaaaaatatgggattcccacagcagcatacgaagtctttgactccccggaggctgccttaagctatctggagactgccggaatgcccattgttttaaaagcggatggccttgccttgggaaaaggagttctgatctgcaatacaaggaaagaagcggaagacggagtaagagccctgatgcttgataagcgttttggctccgcaggagaccggatcgtggcggaagaatttatggttggccgggaggtatctgtgctctcctttgtggatggaaagaccgttaaaatcatgacctccgcccaggatcataagcgggcaaaggacggggaccagggccttaatacaggggtatgggaaccttttcacctagtccgttttatacggaagaagtggatgagttttgcaaagcttatatctatcaggcaacagtagatgccatgaaagcggaaggacgggaatttaagggaatcatattttttggactgatgctgacggaaaaaggccccagagtgttggaatacaacgccagattcggggatccggagacacaggtggtgcttcctcggatgaaaaatgatattgtggaggtttttgaagcctgtattgacgggactttggaagaaatggacttacagtttgaagataacgcggcggtctgcgtggttctggcgtcggaaggatatccggaaatatatgaaaaggggtatcctattgacgggctggaggcatttaaggacagggatggatactttgcctttcatgcaggaagtaagctggacggcaatggaactgtggtgaccaacggcggcagagtgctgggagtgacggcagtcggaagagacttaaaggaagccagagaaaaggcctatgaggcagcggagtgggtttcttttgagaataagtacatgagacatgatattggtaaggggatcgatgaagccggctgattttcggctttggatcagccggaaaaattaaaaagcgtaaatgacaccccccggtttgggcagctgaaccgggggtgttatatgtactctgtcttttgtgaaagataaacggtttatatcacaaatttcataacaatagccgcaatcgtgagaacggcaccgatcatggatattgttctgtagatttttactgattccagatcgtctttctctttgcgcaggtagatcatgcccccaaacagcatccccagacctacgattaggaataagataaataataaccatccgttcattttattttcctccattttaatagcagtgatgaattaataataacggcgactgagccggcattgtgtaccagcgcccccagcaccggggttaagacacctgtaatggcaagagcgatggcaataaaattcagcatcatggatgcggtaaggttgaccctgattgtcttcatcgtcttttttgccagctgcaggagatgagggatttccctgatatcgtcgcccaccaggacgatgtccgctgcatcgatggcaatatcactgccaatgccgcccatagcaatgcccaccagggcgcttttcagagccggtgcatcgtttatgccgtcacctaccatgcaaaccggttcgccttgttcctgaaaccggcggatttcctccagcttcttttccggcaggcagtccgcccgtacatcctggatttttgcagccgcagctatatgagaagcagcggcttccgtgtctcctgtcagcagtactgtcttcactccggtttggtgaattgcttccaccatctgggcagagtcaggacgcagggtatctgacagcgcgatcatgccggcggcagcctgattccttgcaatatagatgatggtggatccgtctgcctttgcctttcttgcagatgcctgaagtttctctgaaatagaaattttctgctctgtcatgaatgcttcatttccagcgagaattttctgcccggaaacctgggcagcaacacctcgcccggccagcagcttaaattcctccggctgtaccggcatggtaccggtcttttgccggtagtcggcaacaattgctttgcctaagggatgttccgaacgtgattccgctgaagcagctaaggtaagcagtgccttttcctctaattccggatccatactatgtatctgcgttacggcaggtttcccgtaggtaagggtaccggttttgtcaaaagcaatgcgctttacctgggacagccgctccaaagcatccccctcccggacgagtatcccccattttgctgcgtttccgataccggccacaatggcggtgggagtggcgagcaccagtgcacagggacagaatacaaccaaaatagtaacagaacgtatgacttcccctgtaacaaaccaggtaattgcggcggccagcaatgcgattacaacgatccatgtcgcccaacggtcagcaatgcccacgatttttgcttttccggcgtcagcggactctaccaggcggatcattcgctgcaaggagctgtcctcgccgactttttgtgcggtcatgtcaaaggtaccgaattgattgactgttccgctgaatacctcatcgccttcgcttttgtccacaggaagggattctcctgtcatgacagactgatcgatggaagtctgccccttgaggatggcaccgtcaacagcaatggtttctccagccaatacgcgaagcacatctccgatttttacctgttcagcaggaatgatctcttctttgcattcccgcaccacacgggcggtggtgggtgttaaatgaaccagtttttcaatgcctgcacgggcattggccaccgtgcgttcctccagataagctccaatggccataataaatgccacttctccggccgcaaagatctctccgatgacaatagacgcaacaagcgcaatggataccagaacatccgccttaatgtcaaattccgtgaccaactgggcggcagccccttttacaatgggaatgccgcagagtaaaatagctgcccacgccgggtcaaccggaaaattaccaatatgaaaaaagctgacgatcagtgcgggagcagataggatgaggaaaagcacagtccgtttttcgtcatcttttataaatgaaatcaagttaacactcctttccatacctatgggggtatgggtatattatacccatgggggtatggcttgtcaataaaaaaacagttgctttgaaaagcaactgtcttttattatttgatttccttatgacattcttgaaaagtgttcaacggccttggcaaaatccgctatggttttttccgcgtctccatgctcaatgccttcccggacgcagtggtttaaatggccttccaaaatcacctggcctaccttatgcaaagcattttttgcggcgtttatttgaatgaggacatcttcacagggaacatcctcgtctaccattttatcaatagcatgaagctgtcccatgattttgttcaggcgtctgtgcaaattttgagaatccatgcattgccgcataagctcacctcctttatacccatgggggtatgcatacagtataccatttttacctgataccgtcaacaacccaaagcttaaaacagaaaggaatgaaatgtgaaaagactttctgttttcatatggcacagcaatctaaaatttggtatactgacatcaaaaatgaaaagaaaatcaagggaaagcaatacattaaggtatagaaccgccagcagctgatcagggatctaaaggatgaggttcctgtcttacagctgtggtaaaaggttaaaagggggcccatatggacagaatattaaaagaatacatattaggagacatgattgcacgctattatctggatgaggaacagcatgttgggctggaattatatccaggggatatgccggttccaaagaatccaggaaaaagggcaaagcttgacgccatggtgcagataaaactggcaggggatatttataatggagcctatgctccgggcaatactctgcgaaacggggaaagcacagaccgtctccgctataagagccaggaagtgatcatggaaggggactcacagacgatccttacatgcctgtgggatgaacggggctatgaagtgcggcactcccttgaatgggaaaaagggcagacatgggtggaaatgtggaatgagctgcttaatgaaagcaggttccctatagaggtggagatgatttccagcttttccctgacaggcatctccccttacctggaaggcgacggccataatcaggtgatggtgcaccgcctgatgagccggtggagccaggaaggaagacttaccagccagaccatggaggagcttcagctggatacctcctggtccagggaggcggtaagatgtgaacgattcggacaggtaggttccttacccgtaaaccgttatttcccgttcctggccatggaagataagaaaaatcatgtgttttggggcgtccagctggcccacggcgcctcctggcagatggaaatttaccgtgttgatgaaaacattgccatcagcggaggactttctgacagggaattcggtcattggatgaaaacagtcaggcccggagagtcatttgtgactccaaaggccattggaacggtatgccgaacggactctgtcgatattttaacaaagaggcttactgatgcagggcaaaaggcagcggatgaggggcctgacccggaacaggaccttcccatggtgtttaatgaatactgcaccacctggggctgtccgtcccatgaaaacatccggaagattctggaatccataaaggagaaaggtttttcctattttgtcattgactgcggctggtacaaggaggccggggttccctgggatatcagcatgggggattaccatgtatcccgggagctgttcccagagggattggaaaaaaccgtaaaggcaatcaaagaggcaggcctaaagcccggcatatggtttgagatcgaaaatgtgggaaaggcttctatggcctatcagatggaggagcatcttctgcacttagatggaagggtgctcaccaccaccaggcggaggttctgggacatgaacgatccatgggtggaggagtatttaacggaaagggtcatcggccttttaaagaagtatggttttgagtatatgaaaatcgactacaatgataccattggaatgggctgcgacggctatgagtccataggagaggggctgcggaaaaacgtggaaaaatcctatgaattcctggaaaaagtgaaacgggaaatcccagggatcgtgctggaaaattgcgcctccggcggacaccggttagagccccgttttatggctgccacaagtatggcttccttttccgatgctcatgaatgtgaggagatccccatcattgcggccaacctccatcgggccatcctgcccggcagagccagatctgggcggtggtcagggaacaggattccttaaaacggatcgcctattctgtaatcaatacctttctggggaggctgtgcttatcggggacgtgacaaagctggataaaaaacaatgggaagtcattgaactgggaatgagtttctataaaaaaattattcctgtcataaagagcgggcagtcataccggtttgggccggatgtagcgagcatacgccatccggagggctggcaggccgtggtccgtataggggaagacggagagaaggcctgtgtcatcctgcatacatttgacggcagtctgtcggagcagattgagatccctcttcctccagggtgtccggtggatgtaattgaggtatattcggacacacgggaagaggttttcgttaaaaataacgtattccggtatcggcccaaggaaaacaggaaggcagtggcagtgctgctaaaaagaatataggtttactttcgtttcataaaaagtcattgacatggtcggtttttcatgatattgtatctgacaggtgatgcgattatgacaaaaggtcaattagaagccaggatcagtgaaattgtcagcaaatttgaagtggaatatatgggaaggggtccaaagaccatccgcacctatattttaagtgatatgattattgtcagattaataggatttttaagtccttctgagaaaaagctgacagagagtccgcagggcgtcgaattacttaagaaagtccgcacttcattatttgagggcggcagggaatatctggaaaaattattagcagatatcatggatgcagcgatagtcagcactcactctgatatcagcacgaaaacaggtgaaaaaatcattgtcatcactgttgataagaatttagaagagctttttacagttaaataacaccggaagacgtcacaaagtagaattaacattctaagttgtaagtaagccgatatccatttcatggatatcggctttatatatatcacaggaaggaggcgatgaaaggatataagacggaaatgaagggaaatccctggggttttcccgttataacggaaggtacgggcatgagaaggggaaggtttttccagacagccccggattgatcacatgcctggaatattaaaatagaaactatgtaatacttaataaaattgggaacaaaggttgaagagaatcacaattaattacatggtttgtgccggccccatgtacggcgcaaatttcagatgtgcataagggcgtgcgcaggaacggaggaaaatatgctggaatctttacgtgatatgaatttacccgaatatgtacaggacatattggctcagtcaaaaggtgttgttattccaaagacaagggaagagctgctgaccctggcaatgggaaatgcagagaataccgagtttcgcattgaatatgaagtgaaaggcaaaggcacggtattggaagcaaccgctacaaagtgtaaaaacggtgttgtggtcaattatacggatgactatatgagaaggcgtgatccggactgtctgctgattgcagataagaagccaacggataaacccagatatgaggaggtttatccgtctgattttgattccttaagaacggaaacctttgactggctgaaaaatcaggagctgatttttttcccatttaaatcaggcggacttgaatatggatatgattcgattttgatctcgccgttaaacgcaggtttttttgctgccggacttgcagatttgcagggatttttaaatattgacgagatttcttccggctttgagccaagagccgttgtttttctggctcctccattcagacatactcattttgacggaaagcagatcgttgtccataaccgtctggaggaaattcatgaagtatattcctataatttatatcctggcccaagcgccaaaaagggaatttacggagttcttctaaatatcggtgaagaggaaggctgggtgactgctcatgcatcaaccgtaaaagtcatcaccccttatgacaatgagatcgtgatcatgcacgaaggcgcctcaggcggcgggaaaagtgaaatgatcgaagacatccacaaagaaatggatggcagagctatcttaggcagaaatacggtgactggtgaaaagaactatctggtattaaatgaaacctgtgatctcatacctgtgacagatgatatggcattgtgccatccgaaaatgcagaatgacagcaaaaagctggttgtcaaggatgcagaatccgcatggtttctgcggttggataatatcaaatgctacggtacttcaccccaatatgaaaaaatactgatccagccggaagagcctcttattttcttaaatatgcaggcagtagccggtgcaacctgtctggtttgggagcataccctggatcagaacggaaaaccctgccccaaccccgtgtcattttaccaagaaggctggttcccaaggccattgacactcctgtggaagtggatgtgagaagctttggcgtacggactcccgcatgtacaaaggaaaaccccacctacggaatccttggaattctgcacatcctgcccccgccctggcctggttatggcgtctggtggcaccaaggggatttaacaatccaagcattattgattctctggaaatgaccagtgaaggcgtcggctcttactggccttttgcaaccggtaaaatggtgactcaggccaacctgctccttgaccagattttgcattcgaccaatacccggtatgtcctgatccccaaccagcatatcggcgcctatgaggtgagctttatgccccagtgggttgccagagagtacattgcccgccgcggcagcgccaagtttaaaccggagcatctggtggaagcacgctgtccgattctgggctttggccttgattccttaaaaattgacggccagtacatcagaagagcatttttaaggccagagacccagcaggaggtgggagtgcagggatacgatgccggagcaaaaatactgacagacttctttactcaggagctgatgaaatattataccgatgatttaaatccgttaggaaagcagatcattgatatgttccttgcaggggctacggttaaggagtacttggaaatcctcccaatgagatattaaaattccccatacagatccatttgctgctgcccggaggccgaaacctccgggcagcaacgtacttgtatactagtgcttgacaatgataaggatttcgcttattctatgtatgaacagaatttgagaaaagaggtcatggtatgcggctgacagaacggtattccaaagagacaggaagggaatatgcactgaggatgttaaaggataacatcatacatcttgatttaattcccgggagcatgttgagcgaaaatgaattatccgcggaaatgcatttgtcccggactccggtacgggaagccttaatcgagctgtcaaaggtgaaaatcgtggagatttatccgcaaaagggaagtgcggtggctttgatcgattataatctggtggaagaggcacgttttatgcgtaatgtcctggaatgcgcagttgtggagctggcctgtaagatggctggaaaagaagcggtcatggagctgaaagagaatgtaaagcttcaggagttttatttggaaaaccgttctcctgaaaagcttcttaagctggatgatgaatttcaccggctgctgtttcacataaccggcaaaaaccaggtctatcagctcatggacagcattaccattcattttgaccggatacgcagcatgtcactgatcgctgtgaaggatttgaaaacgatttccgaccatcaggccattgtggaagccatagctgctaaggacggagccatggcaaaagaattgatggaaaagcatttatccagatataagatcgatgaggaagctctgagaaaagagtatccggggtattttcgttgatctggtttgattcatagaacgtaattctttaagaataaataagagcggcaataaaagatgaaaaggcatccatcttttattgctgctttttttcgtcagcctgaagagggttattgaaaaataggaaagctttgtacataatgtataaaaaaaaagtggatatttattaaatatgctgattgaactactagtatactagatatatactaaaagcaagacttaatagtcataaattattgcgtttagaaaagaataaggagcaaggaaacggaggtattgcagcatgaaaatgattatgcgttggttccctttcggggatgacagcgtgacgcttgaccagatccgtcagaccccgggagtttccggtgtggctacctgcctgcccaaagtgcctgtgggacaggtttggcccctggagaccataaaggccctgaaagaagagatcaatggggccggtcttgagatggaggtaattgaaagcgtcaatatccatgaggacataaaaaagggcctttcttccagggatgagtatattgatgcttatataaagaccctggagcatttaagcctggcaggcgtcaaatgtctctgctataattttatgccggtcatggattgggcacggagtgacctggcttttccggcagaggatggaagctatgttatggcataccgccatgatgaggtgcttcagatgaatccggaaaagatggcaaaggccatggagggaaaggccagagggtattccctgccgggctgggaaccggagaggctttatgccatggctcaggacattgagttttaccagagcatgacaagggaacagtattggaacaatatgaaatattttctggatgcagtggttccctatgcggaaaagtatgatattaaaatggcgatccatcccgatgatccgccatggcctctttatgggcttccaaaggtcattaccaatgcagaaaatatcaggacatttcttgcattaaacaacagcccttataatggactgactctgtgtacaggcagtctgggaagtgatttaagcaatgaccttccagctatgatgcgggaatttggaggtatgaaacggatccattttgcccatttaaggaatgtacgccatacttcggaaaaggattttgacgaagctgcccacctttcttcctgcggggatttagacatgttcgccattgtggaggctttgtatgagtctggctttgaagggtatatccggccggatcacggccgcatgatctggggagaacaggcccgtccgggatatgggctgtacgaccgggccattggagcaaattatctgctgggtctttgggaagccattgataaaacccataaaaataaaaaataggaggcatggatttatgaaactgaatcaatcctgtttaacaaaccgggaggcctgggaaaaggcttccataaagctgccggaatttgactggaaaaaaatgataaagactacggatgaatcacccagatggatccattttggagcaggaaatattttccggggatttattgcggtgctgcagcagcgtcttctggaggaaggccttgaggaaagcggcatcatagcggcagatacctttgattatgatatcattgataaaatatacactccctttgacaatatgaccatgatggtcagcttaaaaccggacggaaccatggacagggaggtgattgccagcgttgccaaaggcgtaaaggccgatgttggcaatgaaaaggatttcggatatctggcggaggcttttaaaaatccgtctcttcagatggtaagctttaccattacggaaaaaggatatgccctggcaaacttccgtggagagctttttcctgtggtggaaaaggacatggaagaaggaccggaaaaggcctgccatgccatgagcgtggtcacagcccttcttcttaaacggtatcttgcaggaggcgttcccttggcactggtcagcatggacaattgcagccataacggggagaagttaaaagacagcgttgtttccattgcaggagcctggacagaaaagggctatgctcctgaggggttcctggcctggatctcagatgaaaacaaggtttccttcccctggaccatgatcgataagatcacgccccggcctgcagaggaagtgcagcggtccctggaagaagtgggcatggaagacatggcccccatcattaccagcaaaaacacctacattgctccctttgtcaatgcggagatcccacagtacctggtagtagaagacaggttcccaaacggccggccaaagcttgaaaaggcaggagcatatttaacggacagagacacggtaaaccggacggaacggatgaaggtcaccacctgtttaaatccccttcacacggctttggcagtctttggctgcctgctggggtataaaagcattgcagcagagatgagagatgaggatttaaaagctcttgtggagaaaatcggctacaaagaggggctgccggtggttacggatccggggatcttaagtccggaggatttcatcagagaggtcattgaataccgtctgcccaatccctttattcccgatgcgcctcagagaattgccacggatacaagccagaagatccccatccgctttggagagaccataaaggcatatctggcagatgatcagctggatgtgcagagcctgaccgccatcccactggccattgccggctggctccgttatcttctgtgcgtggatgatgaaggaaaccccatggagatcagcagcgatcccatgctttcagaattaaaggaccagttaaaggggattaagctgggagaacagcctgaggaaaaggaaggactggaagaaatcctgtccaatcctgttctttttggaactgatttagtttcagcaggcctttctcataagattgaagccatgctttatgaaatgctggaaggtcccggagcagtgagaaaaacgctgcaccagtatgtaaaataagtttttgatcatgaggagccgttggttatggattgaaatcaacggctccttgtgttaaaatgggtctgttggaaaaagaaccggaaaggcggacaaggcccatgaacatacagatttttggaaccggaaaatgctttgaaaccaagaaagcggagcgatatttcaaggaacggggaatcaagtaccagtttattgatatgaaagaaaagggtctgagcaagggcgagtacaatggagttaagcaggcagtaggaggacttgacgccatgcttgatgaaaactgtaaggaccgggaggctctggcgcttattcagtacatcgctgacgaggacaaggatgaaaaggtcttggagaaccagaaggtgctgaaaactcccattgtgagaaacggaaggcaggcctcggtgggttaccggccggaagtgtggaagaattggagttagggacttgcaaaaagaaagaagataaggagaaaacaggatgagagagccggagaaaaatcaaaaatgggtattcaataaggatatagaaggagtacaggcagcagaaggcgttgtcagaaaggttctggcatactgtgatggtatgatgtgtgtggagaaccagtttgagaagggggctgtcggaaagcttcacagccacccccatacccagatcacttatgttgccagcggaaaatttgagttcaccataggagatgaaaagaaggtagtagaggcgggggacagcctgttaaagcaggatggcatcgtccatggctgcgtttgccttgaaaaggggatattggtagatatttttacccctatgcgagaagattttatttcatagaattaaataggacatgtgaaacaaacctattgataaaaatggtattatatgctataaagaaagcacagtgaagttaaaggaggtgataggatggcaaagtatgtttgtgagccatgcggatatgtgtacgatcctgaaatcggtgatccggattctggtattgagccaggtactgcatttgaagatttacctgaggactgggtttgtccagtttgcggagttggtaaggacatgtttgttgaagagtaagattgcggctattatgccagcaataaaaccttcaagctgtcggcaaggattttgccgggcttgaaggttttttgtttttaagaacattccagattggggattgccgggaaagcattgtatgtttctttattgtttataaattacaggtagtatgtagttttcattataataaatggaaagtcaggacaagtgatgcaaatacaatggaaaccatggaagtaagctttatgagaatgttgatggaaggcccggaagtatccttaaagggatctcccacggtgtcgcctaccacagcggctttatgctggctgcttccctttccgccatgtgcaccctgttcaatatatttctttgcattatcccatgcgcctccggagttagccatcatgactgcaagaacaaaaccggtaacagtattgcccgcaagaagagctgacacgccttccggccctaataaaaggccgattacgataggaatgaccacagctatcatggccggtgcgatcatcagcttttgagccgattttgtacacatatcaacgcaggaagcataatccggttccgtttttccttccataataccggctatggtctgaaattgacggcggacctccaatacaatggattgtgcggccttgcctactgcgtccatggtaagggctgcaaacaggaacggtaatacaccaccaattaacaatccgaccagtacttttggattggttatagttaaatccaggttcaggtttggctgaatctgatgcactttatcaacataggaagcgatcagcgcaagagcggtcaaggcagcggaaccgatagcaaatccttttcctgtagcagccgtggtgttgccaagagagtccagtgcgtctgttctctgtctaacggaagcatccatatgtgtcatttcagcgatgccgccggcattatcagcaatgggtccgtaggcatccgttgccagtgtaatacccagagtggacagcatccccactgcagacaatccgatgccgtaaagtcccaggttaaaatcattggcacctccggaacaatagtaacttacaagtacagaaatgctgacgatcactaccggtgcgacagtggaaagcatgccaagagataacccgctgatgatgactgttgcagctccggtttcgctggactgggctaatttttgggttgggctgtatgtatctgatgtgtaatattctgtaatagctccgatcaacacgccggcaatcaatcctgaaaggacggcagcataaagccccatatggtcaggaagcagcatccttatgataaaaaacgccgcaataataatgaccgccgcactgatataggtaccggttctaagggcctttaaaagattcttctgggaggcaccttcctctgttttaacaaaaaatgtaccgataacagatgcgataactcccagcgctgccaaaagcatcgggatggatacgcccttgattccatatcctgcagcaactgcaagagctgccgttgatacaatagaacctacataagattcgtaaagatcagcgcccattccggctacgtcccctacattatcccccacattatcggcaataacagcaggattacgtggatcgtcttcgggaataccggcttctaccttaccaacaagatcagctcccacgtcagcggccttggtaaaaatacctccgccgaccctggcgaaaagggccatactggatgcgcccattccaaaggtcagcatattagccgttatttccgtaatgcgctggtctaccggaagattatgaaaagcagcatttaaaatgaaataccaaatagaaagatccagaagtccaagcccgactacggtaaaacccataaccgaaccggctgagaaggccacctggagtcctttatttaaactttttgaagctccttctgctgttctgcagttagccatagttgctgtacgcattcctatgaatccggacagacctgagaagaaaccacccgttaaaaatgcaaacggggtaaaaaagctaaggaaaccattaaaagccataattaataaaatacaaaaaactgcaataaaaaaaattgcgacccctgaatactggcgtcttaagtaggcatttgccccttttcttacagcctcagagatcctggccatttccgaggtgccctccggttgctttttaacacgaaggaacataacccaggcaaagaaaatccccaacaatgaccccattgatacaaaataaattgcatccattacttcatacctcctgtttcgtattttgatgactccattatagtaccaactaatatatattttcaacagaaaaataaataaatttactaataaaagagcgagatttggccaataatcgtgaagaagtcaggaatttaatgctattttttaacactttcttaacggcattctttaaccgaatcaagtaagtcccctacttcaaatgcgaaaagcattaagtagtgggtgggacttgcttgtgtcaggtggagtacaagctccacctgacaggcagcgacagctgctgttcggttatgcccgataaagcggggcagggcctcccccgcactatcgggacgccgtgagcaactagcgaagcggattgcgaatatccgcttgactattgttactgccattggatgaaaaaacccctgtctctcattgatgagaggcaggggagttaggtacgcgggcacctttttaggcaaagttttggttgtgttcttcattgaagagccattgatacagcaattaactgacgcccggtcccttgccgtcagaggcagggagaggagcagcggttccttcattctggttgttggtatcctgggctgcctgagctgtttgtgctggctgtactgtctgggtaagtgtggattttccggctttttgcagatattccatgatcccttttgcatctgcctctcccagggccttgtactgttcttctgttgacagaaacagggttaagtcgctggtgtggtttataaagccgtgctcaatgataaagccccggatcccatacatctgtgaatagcgggggattgcataataatcggcctggcttccgtcaggaaacatggttccgttttctgaatcccggaggatcagtccccggttgtgaagtcccagagtgcttagctgctttaaaatagtattggcagcttcctgggactggagggccaggtcattgttataccttccggttctgggagccatggagcttacgccataagcattttttaccgtaccgttccccaaagccgagtccacgtgctggcttacaaaaaggtctgcctggacagaggcggcaaaggctgcccgctgatcaagaggtacggttgtttccgcactgtcctttgttaaataaaccgtatagttagagaactgctccagatactgttttgtgtaggaagcaatcttcatggtgatctcatcttcataataggtgattccgttatattcaaagtggcagccggaaaaatgtccgccggtcttgccgtggccgggatccaggactactacaaagttggagttgtttcgcatgcccggtccgatttcaggggcggttattttcgtgatcggaggtgcaaaggccggtccgatctcttcttctgcccatgagacggaagaggaagcggcggaaataaggacggtaaggaaaagggcctttgcggctgctggcagtaagttctttaattgtgtcatgatggatcctccagaataatggcattttgctttatattatatcacttcctgacagattctgtaaatgggcttctatgaatttgtcacctgatgtggtaaaatgtaccgatatagaattcataaaagatggagactgaaatatgaagtattattttgccccaatggaggggatcaccggctatgtttaccggaacgctcatcatatgtttttcaatcatatcgatgagtatgtcactccttttattgtacccacccagaaccggaagtttacctccagggaaaaaaatgattttctgccggagcataaccggggattgcatgtcatccctcagattctcaccaataaaggagaagattttatatgggcagcaaaggaactgaaacaatacggctatgaggaagtgaatttaaatctgggctgtccttctccaacagtggtttccaagggcaggggatcaggctttcttgggaatccggaccggctggaggctttctttgatgagatattttccgcactggacatgaggatttccgtgaagaccagaatcggaaaggacagtcctgaggaatggggaaggctcatggaaatttataataaatatcccataaaggaactgattctccatcccagggtccagagggatttttacagaaatgaacccaactgggaggccgtaaaaacagcggtttccttaagcaaaaaccccttatgttataatggaaacttattttccatggaagattataagaaattcaccgcttactttccatccatagaccgtgtcatgtttggaagagggctggtggcaaatccaggtcttgcaggagaaataaagaacggggagagcatggagaaggggcggttaaaagcctttcatgacgaagttttgaaaggatacgaagagatcatgtcaggggacaggaatatcctgtttaagatgaaggagctgtgggcttatatgatccagatgtttgagggcagcgaaaaacacgggaaaagaatccgcaaatcccagcatcttgaagagtataaggcggcggtggacagcctgttcggagaactggatttaaaggagtatggaggggcttttgacggaagataaggacaaaacccctgtttataagaaaaaaataaaatgatcataaatttatttaatgaatcaacggacattttgaacttgaagctatagttactataggatatataatgacctcaattttaaacggcggcatgttgccgctttgggaatggaggaataacatggcttcaaaagttctgataaaaaatgccaaagcaattgtgacctgcgatgaaaatgaccatgtgtacaaagacgccgatattctgatggatgggcccaagattgcggccataggccgtgagatggaggaagaaggtgcaacagtcattgacgggacagggaagtttgtatatccaggtctaattaacacccatcatcacttctttcagacctttgtaaggaatctgatcaccattgattatcccaatctgacggtcatggactggatccacaagatctaccggatttttcagatcattgataacgatgtcatttactactcaactcttacggcttttgccgacttaatcaagcacggctgtacctgcgcctttgaccaccagtactgctatacaaagaaaaccggcaaggacccggtggaccggcagatggcagcggcggagcttatgggaatccgctatcatgcaggaaggggaagcaacacgctcccccggagcgagggaagttctattccggataatatgctggaaactaccgatgaatttttaaaggactgcgaaaggctcatccgtctctatcacgacccaaaaccctattccatgcgccagatcgtcatggcgccctgccagcccatcaactgccggccggatacgtttattgaaaccgttgctgcagccagagccatgggtgtgcggatgcacactcatttaggggaaggggagacggaaggaatcaaggcccgctacggaaaacgcaccctggaatggtgccgggatattggctttataggagaagatgtctggtacgcccataactgggaagtgcttccggaggaataccgcatactggcggaaacaggaaccggtatttcccattgccctacgccggccgtgctgggaggctttcccattcttgatatcagggccatgcaggaggccggcgttctcataagccttggctgcgacgggtctgcgaccaatgacagctccaatttactggacgcccttcgtttatcctacatgatgcaggcttaccatacaaaggaacgaggcggctgcgtatctgcctatgatatgttaaaaatcgctaccatcaacggagcaaagactttgggaaggccggatctgggttctttagaaccggaaaaggctgccgacttgtttatgatcgacggggaagcattggagcttgcgggagcggtccatgatcctaagaacctccttgcaagggttggcttgacaggaaacgtatggctcactatgattaatggaaaagtggtttataaggatggcgtgatcaccggagtggatgagaaaaagctggcttctgagggggaggcggtctgcaccagggtgatacggaatccaagtgaggcgttccgtccgtttttataggcagcctgaccacggaaagttgaggaaaacggtttgaaggactttttatccattggagagatgagttcccttttcgggttaaatatacagaccttgtattactatgacagcatagacatatttaagccacggatgcgggacataaaaaacggcagaagaaaatatgagtttgaccaggtttatgagctggcaaccatatgttatatgcgaaagcttggttattccctggaggaaatctcaaagcagcggagcacccagcacgcaaattccgcactggattctttaaaacagcgttcagaagagcttcacaggcaatggaaggaactgatttccattgatgaggccattcagagaaagctgcgttttattgaaggagagatgaagaatatccgtacagatgaaattactgtccgccattttgaggacagggcctaccttgccattggagaggaagaggctctctacaggcagaattccttttatttttatcccaccatcgccttttatcagggggaagaaaaatatttcggagcctatttatatccttcagaagagccgttgccggatcatttaagaaaggaccagatacgaaggatccctgcaggcgatttcctctgcggctatcacttaggcccttatgagactgttcccgccaccaccatgcgcatccgaaatgcaagaccggatttacactttgaagaccttaccattaattttaatattctggaccagtttgtggaaaaccagagttccggctatatcacccatacgcagatccggatattgaaaccataaagcaatgacccaattgaccacaagagaggagaaacattatgaaaaacatgagaaagctggcagccctggttcttgctgcctctatggcggcagcatctttggcaggctgcacaaaagcggcagagacaaaagaggtgcaggaaacagcgggaacaaaggctgagactgcaaaaaactttaaggtggcgctctgtctttccggcgcagcaaacgacatgggctggtgccagaccgcctatgaaggattaaagcttctggaatccgattatggctgtgaaaccgcttatacagaaaatttaactcctgatgacattgaagccgcatttgctgattatgccgcaaatggttatgatgtggtgatcggccatggctatgagttcggtgatcctgccgttgaagttgccggacagtatccggatacaaaattcattgtaacagagggtgaggtttctgccgacaatgtagcttcctatgtgaccaaatgcgaagaaggcggttacgtcatgggaatgcttgcagcgggaatgtcaaaaagcaataagatcggttttgtaggtcccattcagggtgcctcccttgtgaaaatcatgaatggctttgaggatggggcaaagtccgtgaaacctgacatagaagtacagactgcgtggaccggctcctttacagatacggctctgggaaaggaggctgcccaggccatgatcgataatggagctgacatcatcggccattgtgccaatgaatccggcacaggcgccatcaatgcggcaaaggaagggaagatttatgccacaggcgattcctatgaccagaacgggctggctcctgaaacggttctttcttcttccgtatatcatattcccaaggtgatcgaggctgcatttaagacagtggctgacggaagctttgcaggaggaatctatgagctgggcatgaaggaaggggcggtgagcattgctccataccatgaactagaggctcagatcccggatgaggtgaaggcagaaattgaaaagaaggtgtcggccatcacatccggagagtttaccgttccatgtgatacaaaggtgagatagggagcttccatatgccattattggaaatgaaacacattacaaaagcattttccggtgtatatgccaatcaggatgtaagtctgtctgtggaacaaggggagatccatgccctgttgggggaaaacggggcaggaaagaccacgctcatgaacattttgttcggcatttaccagtctgaggcaggagagatcctctataaaggagagcctgtccggtttaagtctcctgccgatgccataagccgtgggatcggcatggttcatcagcatttttccctggtaaaccggatgacggtgcttgacaacatcattctggggtatggccataagaaagaaatccttgacagaaaggcggccttaaaagagctttgcctgctggcagggaagtacggactttttgtaaatccccggaatcaggttggcagcctgtctgtgggagaacagcagagggtggaaattttaaaagcattataccggaaggcagacctgctgattttagacgaaccaacaggagttttgacccctcaggaaactgaaaatttctttaacgtattgaagcggttaaaggaagaagggcatgggatcatcatcattacccaccgattaagtgagatcatggcaatcagtgacagggtcactattttaagggatggcagggcggttaaggaactggtcacagcggatactacaccggaggaattgtccgcccatatgataggcagacccctttccggcaaaaaggaaaaaggtcaaaaaccatcagaggaaacagccttaagtctggaaggtgtttccttgtcaaaaaaacgagagagtaaaaaaatcttggataacatctgtcttacggttaataaaggggagatccttggaattgccggagtggaaggaaacgggcaaaaggagctttccgaggtaattacgggaatccgtaagcatacggagggaagcattgtcttccgcggggaggccattgacaacaggtctgtaaaggaacgctttcataagggcatttcctatatatccgatgaccgccataaagacagtctggtcgtggatatgacggtaacggaaaacctgattctgcgcacgtttaaccggccgccattttcaaaaaatctgattctggattataaagaagctgagaaccgggcattagaagccgttacagagtatgggatccgtacgtcgggaaaaagcgggatcaggacgccggtaaagcttatgagcggcggaaaccagcagaaggtgattttatcccgtgagatttccaatgaagccaggctcatcgtggccagccagcctacaagaggcttagatatcggggcaacggaatttgttcatcagactcttgtcaggcagaaaaacaagggaaaaagcgttttgctcatttctgccgatttagatgagatcctttccttaagcgaccggatcgcagtgatgtttgaaggacggatcatggggatccttgacagaaaagaagccgatgtatttaaaatcgggctttatatgggcggagtgacacaaaaggaggtaggcaatggaccaaatgaaaaaaatgaaggcagctgagctggggaaaattgctttgatttccattggtgcggcagctatccttgtccttttgtcaggagctgaccctctcacggcaagccggatgtttttcaacggaatctttggcaataggagcgggtttggggaagtgtttgtgaaagcaactcccttaatcctcaccggacttggctgttcggtggccttccggaccggattttttaatatcggcggggaagggcagttttacataggagcccttgcctcagcctgggtggctttaaataccgccggagttccggggattttccggatctttctggcaattgcctgcggattcctgtttggcggactatgggcattgctggcagccattttaaaggcaaagcttggaatctcggaaatcatatgcaccattatgctgaattatatttccatgaatcttttgggcatagctgtccgcacctttctcatggatccggcgggaagcatcccccaatcggaaaaaatagatgcctcagcaacgcttttacgctttttaaagcccaccaggattcatacaggtatttttatagcacttggtgccgtgctttttgtgtggtttctcatggaaaaaacggccgcaggctatgagttccgggtagtcggctttaataagcgggctgctgcggtaaacggtatttccgtggtgaagaacatcatcctgtcggcggtgttaagcggaggacttgccgggaccgcaggagctgtggaggtactgggagttcagaaaaaactgctggaaggcatttccggaggctgcgggtatacggcaattctcataacccttttggcctccaaccatccggtgggagtgctgattgtctctgttttatttgctgccctggaggtaggcgcaaattccatgcaaaggcagatgggggttccgtcctccattgtggattttctcatcggctttatggtgctgctcattttgggcagagagcttcttgccgggaaaatgagaccaaaggaggggaaatagatgctggaccagattttaaccgtcagctttctgactgcctttttatcggcggcagtacgaatggctgtgcctcttgcctatgcagggcttggggagactatttcggaaaaaagcggaattctgaacatcggaatggagggagtcatgctttccggcgcatttttctcttttgcaggtgcgttttactcaggaagcatgactctggggcttctttgcggcatggcagggggagctgctgtcagcatgatccatggagtcttgtcaattaagctgtcaaaagaccagtcagtcagcgggatcgccatcaatatttttgtgatgggggttaccggttttttgtataagctcatgtcgggggacaatcctaccagcagatccagcctcttcttaaggtacggatcccggtgctttccggcattccgctcattggaaacgctcttttttatcaggatattctcacctatctcatgtattttctggtcataggggcagctctcttttataaaaaaacaaacacagggctttcctttgcagccattggagaaagtccccgttccgcagattcggcagggataccggtttacaagtaccagtacatttccatggttttaaacggagtgctggggggaatgggaggtgcatatctggttctggtacaggtggggaatttttcggaaaatatgacctccgggcggggctacattgcccttgcagctgttattctgggccgctatgttccttttggaatgatgggagcagcccttttgttcggcgccgccaatgcgctgcagatccgccttcaggcagttggtgttccccttccctcccaggcattgtccatgcttccctatctgatcacgttggccgccctcctgggtaccgctgggaggagccatgcaccggaaggtcttggaaagccttatgtacgcggttccagataagatctttcttttaaatgaaaacgcctgaactcttattttgtaagagttcaggcgttttttactcgttggtttttcagcctttcatttcatgataaaaaaagaagaaaatatcctgagaacgaatattttgtatgtcaatggttgaaattaactatatgttgtggtatatttttacatgtgatattggataacagttattgatactaatataaatcatggaatggcgggaattataaatggacaagagaaatgggaaacaggaaattctggaatattttaaagcggtagaggaactggaagaagtattggacggaatccaaaaggagtgggattccccatcctatgacctggatcacctttccataaaattcacagggttttgcaagaaagatatgagccttgaggagcggttgggagcactgatccaggcggcggtggagctgacgacccaggaagcgccggactgggaatatataggagcaagacttctcctgctgcgttttgacatcaggttaaaggcagagcttgaccagaggcagattggcagcttttacgataaaatctgttttcttacagaggaggggctttacggagattacatactggagaattacaaggaggaagaaatccaccggtatgaaacgttcatggatcaggagagaaaccatctgttcaactattcagggctggagctgctgcttaaccggtatgtgatccgaagccgtcagaatacgcctttggaaacaccccaggaaatgtttctgggaattgccatgcatcttgccatgctggaaaaggaagaccgggagacttgggtaaaacggttttacgatatgctcagcaccttaaaggtcaccatggccacccccaccctttcaaacgccagaaagccttaccatcagctttcctcctgctttattgatacagtgccggacagcctggatggaatttaccggagtattgacagctttgctaaggtcagcaagttcggaggaggcatgggcctttactttggaaaagtccgagctgcaggaagcgcgatccgcggttttaagggagctgcgggaggtgtgatccggtggatcaagctggccaatgataccgccgtggcagtggaccagctgggagtgcggcaggggcggtggcggtttacctggatgtctggcataaggatctgcctgaatttctgactctgaaaaccaataacggcgatgaccggatgaaggctcacgatgtttttcctgccatctgctaccccaatctgttctggaagcaggcaaaggagaacatcgagggggactggtacttaatgtgccctcatgaaattctgactgtaaagggctgggcgctggaagactcttatggagcccagtgggaggagcgttaccttgattgtgtaaatgacagccgcatccagaagcgggtcatccccattaaggacatcatccgtctggtgttaaagagtgccgtggagaccggaacgccttttacttttaaccgggatattgtaaatgaggccaatcccaacagccactgcggcatcatttactgcagcaacctttgtacggaaattgcccagaacatgagcgccgtggaacacgtggagcagcagatccagacaatggacggggaaaccgttgtggtaacaataacaaaacctggtgactttgtggtctgcaacttagcaagcctttccctgggaaaaatcgatcttaaggatacccgggaactgacggaactgaccaggagcgccatccgggcgttggacaatgtgattgacttaaactttttccctgttccctatgcccaggttaccagccttcgttaccgtccggtggggcttggggtgagcggatatcaccacatgctggcaaaaaacgggatctcctgggaatcagaggagcatttaaaattttccgaccgggtgtttgaagcaatcaattatgcggcgatccagtccagctgcgactttgctgaggaaaagggaagatatgatctgtatgaaggcagtgaatggcagacaggggcgtattttgataaacggggatattgctctgaaaagtggaagagccttcgggaaaaagtggctgcccacggaatgagaaacggctggctccttgccatagcgcccaccagcagcaccagcatgatcgccggaaccacggcaggactggaccctgttttaaaccggtattatctggaggaaaaaaagaacggtctggtgcccagggtggccccggacttatcgccggacacattctggaagtataaaaatgcccattacattgatcagaaatggtctgtgcaggcggcaggagtccgccagcgccatgtggatcaggcccagagtatgaacctttatataaccaatgactacacccttcgccaggtgcttggactttatatcctggcctgggaatggggtgtgaaaaccatttattatatccgctccaaaagtctggaagtggatgactgcgaggcctgctccagctaaagggcctttaggagaataataaaactggagaaagtgaaaagaccgatatggaacaattaaaaaagaggcccctttttcatccggatggggaaattgaggtaagaaaacgccggatgatcaacggcaacacgacaaaccttaatgattttaacaacatgaaatacacctgggtaagtgactggtaccgccaggccatgaataatttctggattccggaagaaatcaatttgagcagggaccggaaggactatcctttattaagtcctcaggagcggcgggcttatgataagatattgtcctttctggtgttcttagacagcatccagaccgccaatttaccggcccttggggaatatgtgactgctaatgagatcaatctctgcctttccattcagacattccaggaggcggtgcacagtcagagctacagctatatgctggataccatctgtgagcctcagaagcggaatgaagtcctctatcagtggaagagcgacccttatcttcttgcccgcaatacctttatcggtgatctgtataatgaatttcaaaaggacaaaagcgcatttgcctttatgaaggcggttgtggctaattatattctggaaggcgtgtatttttacagcggttttatgttcttttataacctgggacggaaccataagatgacaggttcctcccaggagatccgctacatcaaccgggatgagaacacgcatctttggctgttccgcaacatgatcctggaactggtaaaggaggagccggagctgtttaccagggaacgggtggaggtttaccgggaaatgatcaggcaaggctgtgagcaggagatcgcctggggctgctatgctatcggagacgaggtgccgggccttaccagggaaatgatcacagactacatcatgtatctgggaaatttacggtgtgcaagccttggctgggaaaagatctatcagggccatgacagggagccggagaccatgttttgggtcagccagtacagcaacgccaatttgatcaaaactgacttttttgaagccaaaagtacggcctatgccaagagcagcgccctgattgacgatctgtaaaaagcagaattttaataataataattgtttttattttaacgatgtggtatgataagaaaaaagacttttaaggaggctatttatggaacgcatcgttgtaatcggggcaaaccatgccggaacggcagcaatcaacacaattttagacaaatataaagataaaaaagtcattatatttgattccaatgacaacatcagttttctgggctgcggtatggctctttggatcggggagcagatccattcctcagaaggcctgttttattgcaacaaggacatatttgaagaaaaaggcgcaaaggtttacatggaaaccaaagtggaccgcattgattatgataaaaagcttgtttatgctgtgggaaagtatggcaggagataccagcaggaatacgataaactgattcttgcaacaggttctcttcccatatctcctgatattgaagggaaagatctggacaacgtccaatatgtaaagctgtttcagaatgccaaggatgtcattgataaactgcaccatgactccataaaggatgtggcaattgtaggggcagggtatattggcgttgaattagcggaagcattccgccgcgtaggaaagaatgtcaccctgatcgacaacatgcacacctgcctgtcaggctattatgatcaggaattttccgatatcatgtccgagaacttaacaagccacggcattcagctggtttatggagaaaccgtgaaaaagctgtccggaaacggcaaggtggaaaaagtgatcaccgacaaaaacgaatatcatgccgacatggtaatactgggaatcggttttaagccaaataaccagttaggcagggacgagctggagctgttctccaatggagcgtatctggtggacaaacggcagcagaccagccgccctgatgtatatgcgatcggtgactgtgcaaccgtttttgacaattccattcagaaaacaaactacatcgccttggccaccaatgccgtacgttccggaattgtggctgcacataatgcatgcggcactcccctggaatccattggcgtccagggatccaatgggatctgtatctggaacctgaaaatggtttcaacaggaatttcttatgcaaaggccaaaaagctggggtatgatgcggcagcagcggattatgaggatacccagaaaccggcctttattgagcatgacaattataaagtgaaaatcaggatcgtttatgataagaaaacccggatcatcctgggtgcacagctgtgttcagaatatgatatttccatggcaatccacatgttttcccttgcgatccaggagcaggtcaccattgaccggttaaagctgacggatattttcttcctgcctcattttaatcagccttataattattttaccatggctgccctgcaggcggaataggccgggagaatatgagtctcaggaattgagagaagaaaaacgttaaaaataaggaagtcagcctccggtcgttcccggaagggaatggccggaagccggcttcttttattttatgacaaaaaaacacagaaagggaatcttaaggcagcattgccacaaggtaatggcggcagccaaagcggaggtcttgacaattggtttcattcatgttagtatgagaatgctctccagaagagtaccagtcaggggcagtactggtttcgacaggggctatgcagctggtgaagctatccgcatgcgatgcgttaaatggcaaacctaaatataaacgctaacaataacgaattagcattagctgcttaatgcagcttgtcggccttaaggcactcacactttaagatcccggcatcgacgatgtgagaaacgacgtttgcaaagctttgagcatacggtcgtaatatgaagctactgaagctgtcagggtgttagttcccgggcggtggagggaatgtcaataaactaactatgatagtagaagaacagggaattggtttttggacacgggttcaactcccgtctgctccactcaaaaaagtctggtatttaccaggcttttttatttttgcgttgcacattatgttgtgttggctcatattgccggttaatattatggctcagcttttttcctgcatagctttttatgggttcttaagcatgaaaaaggagcagctgctccaatagattctttcatccatttgtgcaccagcccctttttcttttatttggtcaaaaaaacagttcgtttaaaattccgcagaagcgcagttgtcgcctgaagcgaatgtcattttcttaatgttcaacttatcttttagcaggctgtagaaaacttctatgaggttttcgcaggtcgcaactttctcaactaccacaagacggcactcaggataagcttttgccaacgcggtatcaaatggctcgccaaccatggtattggtttctgcaccgtcacggattccctgtgcttcatatacttttaatatttccggtaagatgggatcttccttctgtaaaatcagagcatggtcaaagttttttaagtaatcccaggcaatacgtttgatactgttgcaggggtacacaaagcctgttctgccgtcaacatcaccatcaacctcaatggtaagcaaaccggtatgtccgtgaagatactgggcctctccctcataattgagaaaacggtgggagtactgaatgtttaattttgttatagatcgcatgataaatacctccttttatattttaagcacatactccttagagtcatgcttatttgctgtcttttccctgtctgcaagaagggcaaatatagctgatttttaaatcataagaaagaacttcttctccaatttctttttttagatttgccgttagatccttaagtacaatatcggataaacgcccgcactgtttacagaccagatgatcatgtcttatgatgtttttgtcatatctatctggacttccctctattacaaccttttgaatgagctcattctcatacaatgtatttaaattattgtatacagttgccagcacgatctttgaggaagtctccttcaatttcagatagatctgttcagcagtaaggtgttcttctgatgaattaataatatcgagaattagtgatgaataagcagtcatattattactccttttagaattattctaattataatatcgcgggtgggtgttagtcaaggctaacttttttgaattatctttaagcataaaccttgattgtttgtcaaaagcaaaagctgatgaaacagcggaacatccatcggaccaagcagccctgttgtcaatcaccatttcataggatcgtaaagttttagagaaacgtttactgcagtttttcttcttccggcttgtttctgaatggcagatagtctaaaaatctcttaacagcgagggaagcagtttttttatctttcattgctagaccaatattgcggtaggcaggtatatccaattcctttactgcaatcctatacggaatacgctgtaagatcagttccggcagaatgctgatacccaatccactttctaccatagacatgatagcgtaatcgtcccatgtcgtaaaatgaacttttggtttgatattgcatttttcaaatatttcccatatttcagccttagcgcctttttctaaaagcatgaaagggtaatcacacagcgcttttaccggaaagcgctcacaatgagccatagggtgattttccggcagaactgccagcagtttatcttgatctaaaaaggttgtttcaaactctgaaagtgtaggcagtctgagaaagccgcaatccacacgtccctctaaaatccagctttcaatttctgtgtagtcacccagcagaagctcataatcaatattagggtaatccttttgaaactttttaatgatattagggagccaatgagttgccacgctggaaaacgtaccaatccgaatcaggccggactgcaaaccgtttaattcgtctacctgtgcctgtaatttttgatattcgctgcacaccctttgagcaaatggcagcagcattaatccatcagaggtcaggcgtacaccagcccgtccacgctcaagcagcgaaacctgccattccttttctaaatcattaatcatgcggctgatgccggattgggagtaattcagcagctctgctgtcttagtaaaactgccatactcaacggttttaacgaaagccatgtatttctgaatgttcatgtccatataatttcaacctcctttcatctgattttgtcattctaaccatgataaacatttgtttttgtaatttatgaaaccatgatacactatgaatgccaaaagtgcaagggaaaggaaattgatgatgttctttataagtgatatttatacgactgcgccgtccgggtttaaaacggatttacaggaaaaaacataccatgcgcttaatattctccatatcccatttgagcgtgtggataccgatgaagcaattacaatggatgattgcttccagattaatgagaagctgaacgtgaaaatggtaaagaccttgtttctctgcaatcgccggcaaacagccttttacctgtttattactgcaggtgataaacctttcaagtcaaaggagttcagcaatgcattagggctgtctcgtgtatcctttgcccctgcggatttaatggaaaagatgttgggaacgaagattggtgcggcaacagttttcagcgcaatgcttgataccgatcatgctttggaaatagtctttgacaaagatgttgtccgtgaagaatggtacgggtgcagcgacggtacaaccacgggttatatgaagatcgaaacaaagcagattattcacaggtttttgccgcttacaaaacatatgccggcaattgttgaggtgtaatatgggattgtatcaaaaccgaatcgtagtaaaagtcggcacttccacggtgacaaatgaaatcggcagaagtgttggaacactgtttgccgggagggggcaatgaatcatgcatacgctttgaaatccgcctctttcacatcttgtctaagcgtcccatataatatagtacataaataaaagagaggtgtgaaatatgggctgctttttcggatcctgctggaataactgtagatgcaataacaattgcaacaacaactgcaacaataattgcggcgaccgtgataattgtgcagaagaaagaagaagagcatactgggccggctttagagatgggtgcaatgatccacgctgccgttggcgcaatgaaaacgataattgtgattaaggacggaggagcggaggcctgcataggattcaggcctccgctttttcatggacctcctgcttttggattccttggtcctgtcatgaaataatacagacacaatttccgggacctctgcatatgctgaatgatatgataaaagtgtcgaaggaaattcaggacaatgcgcggggagaaaatgtggcggaatcgcatttgggatggaaggcagtatgatcatggggtcatcaggcttcaagtaaagggaatatcctgttacaacagggctgcgaagtatgaaccaaagattacaaggcaggtcagggcaatggcaaaacgggcaggaatggacatggcgggaatggaaaaccgcataaaatccaggaattcatatctgaaaaagatccaaaggaaatacggtccgggatttcagggatatgaggtaaaggacatattaagatatacttatacggctcctgcggaagagcttgcggagaaggttttaaaaaccatggagctttatttggaatcaggctatgatacagttgaaatcaagaattactggcttgacaggcagagtccttataagggaatcaataccaccttgcgctctcctgaaggccagatttttgagctgcagtaccatacgccggaaagctttttaataaagaacggaaaaatgcatgagttatatgaaatgcaaaggcccataaaagacatgagcagcaaagagtacttagaactatggaaccagatgcttttactttctgattctgtgaagattcccaatggaatagaaaaggtaaagggttagaaaaaaatctgatttctgcagttgaccgccgtgatgccatgccgccatgaaagatccatggctgttataggcagcagggcggaaagttttttggacatgggaatggaagccctaaaatgggttatcatagtagaaaattcacaaaattttcaaaatttatcgggttgcaaaccagggtataaggtgatatactgctgtatagttaattagctaattattagtaagctaacagaaaggggaatatttgcaaatgaaaccaatgtgtccgttccgggataaaggattaaagggaaacctttcgccgacccatggcgtgatggtaagatatatgaggattatgaagctgcaccgatatattctggatgaacgcttaaagcagacaggggtataccgcagtcagcatcagattctcatgatgctttccgatcactccaatgcctcccagaaggagatagcagaacgcctttatgtgtccaccgcaaccatagctgtatcggtaaaaaaattggaaaaagggggatacatcacccgggccgtggaccaggaagacaaccggatgaataagctctgcctgacggaaaagggaaagcacatggtggagcacagccgggaattttttcataatgtggaagaacggatgttccgtgatttttcaaaggaagaattggccgccatgggacaatatctggaccgcatttatgacaatttatctcagatccccttggaaaaggacatgacagaaagagaggattgataacttgaaacgatattggaaatatatcagaccgtatctgggagcctttatccttggcccgctcctgatgctcacagaggttttaggagaaatcatgcttcccaagctgacctccatgatcattaacaacggagttgcaggaagagacatgggatacattttaagtatgggcgggagaatgctggttatcgcccttttcatggcagcaggagggatcggaggctcttatttttcttccaaggcttctatttgcttcagtacggacttaagaagggatgtttttcataaggttcagcagttttcctttaaaaacatcgatgatttcagcacaggctccctggtcaccaggctgaccaacgatatccagcagattcagaatgtggtgatgctgagcctgcgtctgatgttccgtgcaccgggaatgctgatcggaggccttattatggcctatctcatgaaccggcagctgatggtgatattgctggcagtggtccccatactggttctggccatattcattattctaaaaatagcatttccccgttttgaggttatgcaaaagaagatcgaccgcttaaactccggagtgcaggaagcgttgacaaatgtgcgggtgatcaagtcctttgtcagggaagattatgaagaaaagaagtttcaggccacaaatctggatttaaaggaaggcagcttaagtgctatgaggatcgtcatagtaagtttgcctgtgatgacccttgccatgaatatcaccactcttgccgtggtttggtacggaggaaatctgatcataggcggaaacatgccggtaggtgatcttacggcatttaccacttatattgtccagattctcatgtctttgatgctcttatccatggtatttttacaggcctcccgtgctatggcctctttgaggcgtgtgagagaagttctggatacagaaattgatctgaccgatgaccatgcggcggaaaaatctgcccaggtcacaaggggaagggtggaatttaagaatgtttccttccagtatgtaaagggaaggtcgaaaaatgttttaaaacacattgattttacggcggagcctggagagaccattggaatcatcggttcaactggaagcggaaagacgtctcttgtgcagatgattccccgcctttatgatgcggacgagggacaggtcctggtggatggcattgatgtaaaggattattccatcagaaacctccgaaagggcgttggaatggttctgcagaaaaatgttcttttttccgggaccattgaagaaaatcttcgatggggagatgaaaacgccaccatggaagaggtggtgctcatggcggaaagcgcccaggccgacggctttgtctccagttttacggacgggtatgacacggatctgggccagggcggctccaatgtatccggcggccagaagcaaaggctttgtattgccagggctcttttaaagaaaccgaaaatactgatcctggatgacagcacctctgccgtagacacggcaacggaagcccgtatccgccaatgttttcagacgactttaaaggacaccaccaaattcatcattgctcagaggatcggttccgtagaaaatgcggataagatcatcgtgcttgatgacggacagatcgtaggcatgggatcccatgaagcgctgctggagtcctgtgaagcttatcaggaaatttattattcccagagagaacgggaagaggaggcaggtgcatgatggataagcggaaaaaaatagacagcctgaaaaagcgttacggccggacttctctgcccgtcaagagccagggagcaatgggagggcccggaggaaaccggcaggtaaagggcggcattccgaaaaatgccaaggcaacgatccgtcggctgatgtcttatttaaacaaatacaagtttttcatgggagcggcgcttttctgtgtcatcatcggcaccattgccatgctggccggctcttacatgctgcgtcccatcatcaatcagtatatagccccttccggcggaggaaggggaagtgtttcaggacttgcaaaaggtcttatggccatgggaagcgtttattttattggggtgatcgccaactatgcccagtccaggatcatgctgacggtggcacaaaacgccctgcaggaaataagggatgacctgtttaaaaagatccagactctgccggtgcggttttatgatacaaataacaccggagatctcatgagccggttcagcaacgatgtggataccatcggccagatgttaagcaataccctgatccagctttttaccggtgctttaagcatcataggcactcttgtactcatgatctacacgaacatctggctgactctggtgaccataatcatgatacctgtgatgatgaaggtgggcggctttgtggcttcaaaaagccagaaattcttctccgcccagcaaagctctttgggcgctgtgaacggatatattgaagaaatcatcagcggccagaaggtggtaaaggtattctgtcatgaagatgtggcagaagaagagtttgagatcctcaatgaggatttaaggaacaatatgatccatgcgcagtttttcggaggcgtaatgatgccggttatggggaatttaagccagttaaactacatcctgaccgcatgcatcggaggactgctctgtgtgctccggggctttgatgtgggcgggctgaccgtatttttaaccttttcaaggcagtttggacggcccatcaacgaaatgtccatgcaggtgagcaatgttttctccgcccttgccggtgcggaacgggtattttccattatggatgaggagccggagcaggcagatgacgaagatgcggcagagctggagcctatgagcggatatgtagaactgaagcatgtgacctttggttatgatcctgataaggtgatcttaaaggatttaagcctttatgcaaagcctgggcagaagattgcctttgtaggctccacaggcgcaggaaaaaccacgattacaaatcttttaaaccgtttttatgacattcagggcggtgagatcaccattgacggagtggatatccgccatatcaagcgggagaatctccggcataacattgccatggtccttcaggatacccatctgtttacagggactgtaatggagaacatccgttacggaagacttgatgcaacggatgaagaggtgatccaggccgcaaagacagcttccgcttattcctttatcatgagactgcccgccggctttgataccgttctggagggcgacggggctaatttaagccaggggcagagacagcttttaaacattgccagagcagctatttcaaaagcgccgatcctgatccttgatgaagctaccagctccgtggataccagaacggaaaagcacattgaacggggcatggaccgcctcatggcggaccggaccacatttgtcatcgctcaccggctgtctacggtgcgcaattccaatgccatcatggtattggaaaacggtgagatcattgaacggggagaccatgaggatcttttagaccaaaagggcagatattatcagctttataccggggcagtggaactggattaaccaaaggccacaccctgcattcccatttgggagcattggagaaaacggcagccatgcagtcacttgtgattccgtttcccaatgttccttttttatttattaaaaattctaataaataaagggcgtaagtgataaaattcatccattaaaacccatgaaaaacttttataaaaacgaaaatttaacaaaaatttcacaaagtatagtgtataaattcaaatacactgtcataaaaagggagattatgaggattaacaaaaaaagaaccggattgattgtatttctatgaaaacataaaaggctcactttttttgagaatcgtcatttatttaacacaataaaagggtctaaaacgaggttttgctcctgataaatgaaaagagttgtatataaaacacagtatacaatatgtaattatgcattgtttcgatttgcgaattatgttatactgtctcaggaggcaaaatgctgaaattttgccgggagagacaaagaaatgtatagaaagagggttagttaaatgggtctggctacatttaaaggcggcattcatccttacgagggaaaagaattgtcggaaaataaacctgtacaagtgttgcagccaaaaggcgagatggtgttcccaatgtcccagcatatcggggcaccggcgaaacctttggtggcggcaggtgatcaggtgctggttggacagaaaatcggggagccggggggctttatttcagcctgcgtgatcagctccgtttcaggtaccgtaaaaaccattgaaccaagactggttgctaatggctctatggtcctgtccgttataattgaaaacgacgggaagtatcagacggtagaaggctttggaaaagaacgtgatcctaagactttatcaaaggaagagatcagaaacctggtaaaagaagcaggtgtagtagggcttggaggtgcaggattccccagtcatgtgaagctgacgccaaaagatgaatcaaagattgatacgattatcgtaaacggtgcggagtgtgaaccgtatttaacttccgattaccggatgatgttggaagagccggagagtatcataaaagggcttaatataatccttcagctctttgacaatgcaaagggagtcattgctattgaaagcaacaagccggaagccatcaagctgatgacagagcttgtaaaggatgagccaaggattaccgtctgtcctttacagacgaaatatccacagggaggggagcgtaccctgatctatgctgtgacaggaagaaagatcaattccaccatgcttcctgcagatgttggctgcatggtagacaatgtggatacggttatttctatatataatgctgttgcaaagaacattcctctgatccgccgcatcattacggtgacaggagatgccgtggcaaatccccagaactataatgcaaggatcgggaccagctataccgagcttttagaggcttccggaggttttaagacagaagctgcaaaggtgatttccggtggcccgatgatggggcaggctctgtttaatttaaatattcccgttacaaagacttcctccgcccttacctgcatgacaaaggatgaggtggcggaaaatgcgcccagcgcctgtatccgctgcggaagatgcgtaaaggtgtgccctggcaatattgttccacagatgataatggaagctgcggaacggtcggacatggagcgttttataaaattaaacggcatggaatgctgcgaatgcggctgctgtgcatatatctgccctgccagaaggcctcttacccaggcatttaaagagatgcgcaaagaagttgcggcaagcagaaagaaagcgtaggaggaggaagcatgagtaaattgttaaacgtatcatcatcgcctcatgcaagggatcaggtcacaacacagaatattatgctggatgttgccattgccatgattcctgcgtctgcgtatggtgtatatcagtttggatataaagcagcgctgattttgctggtcagcgtattgtcctgtgttctcagtgaatatttatttgaatcccttatgggaaaacctgttacagtaagtgacggaagcgccctggtgacaggaatgatcctgggccttaacatgccccctgccatacctttatggatcccgtttctgggaggcgtattcgccgtcatcgtggtgaagcagctctatggcggtcttggacagaacttcatgaacccggctttggcggccagatgtttcctgctcatttcgtttgcaggaaagatgaccacatttacatacaatgatgcggttgcaggccccactcctcttgcttcattaaaggcaggagaggcagttgacttaacggccatgttcattggaaagatttcgggaaccattggcgaggtgtctgtgatcgccctgctcattggcgcagcctaccttttattcagaaaggtaatttccatccggattccggctgcttatatcatcactgtagctgcatttgtctttgttttcggccgtcatgatcttacgtacgtgctgactcatatatgcggcggcggtcttatcttcggtgctttcttcatggctaccgattatgtgacaagccccatcaccccaaggggacagattattttcggcgttcttttaggcgtgctcaccggattattccgtttgttcggcgggtctgcggaaggtgtttcctatgccatcatcatcgccaacattctggtgcctttgatcgagaagatctctcttccggtagcatttggaaaggaggggaagtaagatgaaaaacggcggatttatgaaagatgcagtgattttatttttaatcaccctgatttccggctttttgctgggcggcgcttatcagatcacaaaggaacctattgcaaaggcaacggaggccgcgaatcaggcggcgtataaaaaggtatttccggaagcagctgattttatatcggatgatgaaatgaaggcagccgtggaagtctgtaacgcagaactgctttcccagaactttggaaaggcagccgtggacaatgctcttcgggcagtggacggaagcgggaccgttatgggatatgtaattacttcccattctgatgacagctacagcggtgtggtgcagatctccgtgggcattaaagaagacggagccattaacggcattgagtttctggccatcagcgatactccgggactgggcttaaaggccaaggaaccggcgtttaaggatcagtatgcaggaaagaatcaggaatctcttaccgtaacaaaatccggcaatgccggtgacggcgagatcaatgccatcagtggagctaccattacatcaagcgcagtaaccaatgcagtcaatgccgcattgtattacgtgcatcacagtattgaccggtaggaggtgggaagatgaacaacaaatgtgtagaacgtttatttaacggtattgtaaaagagaacccgaccttcatcctgatgcttggcatgtgtccgactctggctgttaccacgtcagcggtgaacggggtgggcatggggctttccacgaccgtggtgcttttattttccaatatgcttatttctgcccttcgtaagattatcccggaccgggtgaggattccggcttatatcgttgtcgttgcgaccctggttacgatcgtgcagcttcttttagaggcctatgtaccaagtctgtattctgcccttggtatttatatccctctgatcgtggtaaactgtattattttaggccgggcagagtcctatgcttccaagaacggcgtgatggaatccacctttgacggaatcggtatggggcttggctttaccgttgcccttacctgcatcggccttgtccgtgagctcttaggctccggcgcaatattcggatataccatcattccggaagatttccatatttccatttttgtcctggctccaggcgcgttctttgtgctgtctattttaacagcccttcagaacaagtttaaagcgccttccgcaaccaacggttcttcttctaattctgaattagcctgcggcggcaactgtgctgcttgcaccggttcctcctgcatgtccaatcatgaggttcttcaggccagaaagaagcagatggaagaggaggccctggcagcaaagaaggcacaggcagcaaaaaaggaagcagaagcaaaagcggcggcttccaggaaagatgaataggaggatgggtagatgaaagaattgttattgattgccattggctccgcattggtcaacaacgtagtgctcagccagtttctcggcctttgtccattccttggtgtttccaaaaatgtgaagacctctgccggtatgggcgcagccgttattttcgtaattaccattgcagcatttgctaccagcgtgatttataagggaatcctggtaggacttcatctggagtttttacagaccatcgtgttcatcctggtcattgcggctctggtgcagtttgtagaaatgtttttaaagaaatcaatgcctgctctttatgaggcgctgggagtgtatcttcctttgatcaccaccaactgtgcagttttgggcgtggccttaaccaacgtgcagaagggatataacattctggaaagtgttgtcaacggtgtgggtatttccgtaggctttaccattgccattgttatgctggcgggtgtccgtgagagaatcgaatacaatgacgttccccattcttttaaggggtccccaattgtcctgattacctccggcctgatggcaatcgcatttttcggattttccggattaatcaaataaggaggagacgaaagaatggtaacaggtatcatattagcggcagctattgtgggcgtcatcggtattttgatcggtgtgttcttagggattgccagcgaaaagtttaaagtagaagtagatgaaaaagagattcttgtccgtaatgagcttccgggaaacaactgcggcggctgcggatatgcaggctgtgacgctctggccaaggccattgccgcaggtcaggcagatgttgctgcctgtcctgtgggcggtgcagcggtagcagaaaggatcggcaggatcatgggaattgaggccggttctttggataagaaggtcgcctttgtaaaatgcaagggaacctgtgataagacaaaggtccagtacaattattacggaattgacgactgccggatgatctcggtggtgcctggttccggagaaaaagcctgtgtctatggctgcatgggatacggctcctgtgtgaaggcctgtgagtttgacgccatacatgtggttaatggtgtggcagtggtggataaggagaagtgcgtagcctgcggcaaatgtgtttctgcctgtccaagcaagctgatcgacctggttccctataaggcaaagcatctggttcaatgtaattcccatgacaggggcaaagacgtgaaggcaaaatgtgaggtaggctgtatcgcttgtacgctgtgtacaaagcaatgtgagttcgacgccattcacatggataataatgttgcaatcatcgattatgagaaatgtaccaactgcggaaaatgcgcggcaaaatgtcctgtaaaggtgattcagtaaaataaaaaggagttcggtcttttaaaaaggaccggctccttttttgcttgaggtattacttaatgccgtcagctgggctgagtttattgctccatgaagcggcataaagatgcgcatggaaaaggctttaagcccctttccatgcgcattatttattttgagccatacaattacatagattggaatcatgacttcatatctgcagtttttaattaaatttcaaaattgaaataccttacagcattgttaaaggaaattccctcaatgatttctttcagggcttcctggtcatccggatattctccgttttccacccagccgccgatcagctcgcagaggatcctgcggaagtattcgtgtcttgtataagataagaagcttctggaatcggtaagcattccgatgaagttaccaaggcttcccaagtttgccagagaggtcatctgctcggtcatgccggccttatgatcattgaaccaccatgcggagccctgctggatcttcccggggaatttgctctggaaacagcccaggatggttcctatggaggcgttgtcattggggtttaaggagtaaatgatagtcttgggtatctcatcggttgcgctcagtgcatttaagaaatcagccatctgtgcggaaggagcgtagttgttgatgcagtcaaaaccagtgtcaggacctatctgttcaaacatcatggcattattgtcacgcttgcagccataatgaagctgcatcacccagcccatgcggttgtattcttttgcagcgaacagcatgaaagcagtcttgtattttaattcatcttcccttgaaatggccttgccgccaagtccttttgcaaagatctcatcaagctccgcttcatcggcaggagcgtacataacgtattcaagagcatggtcggatacgttgcagccctgacttgcgaagaattccatacggttctttaaggcagcctttaaggaagcgaaatccttgatttccacgccgcttgcagcggataattttgccatataggcggcaaaatctggtttttcgatgttcatagccttatcaggcctccaggcaggaagcacttttacttcaaaggaaggatcctcagcgatttttttgtgccattccagcgtatctgcaggatcgtcggtggtgcagatcagtttgacattggactgtttgatgatatttcgcacgctcatggaatcctcatgaagcttttcgttgcataaattccatacctcttccgcggtattaccatttaaatggccggtataaccgaaatatctctgaagctctaagtggctccagtgataaagaggattgccgatcagctttggcaggatttctgcccacttctggaatttctcgcggtcagaagcatctccggtaatatatctttcatccacgccgcaggagcgcatctggcgccatttataatggtcgcctcccagccatacctgggtgatggtatcaaatttgcggtcttcatagatctcctggggattgatatggcagtggtagtctatgatgggcatgttctccccataggtgtgataaagtgccttggctgaatcggtagacagtaaaaagtctttgtccataaactgtttcatgttagagagtcctccttgaatatatgaaattaaaaattagtagtacctcgttttaccagctcaggggtaatggtagttttcgtagggacgttacccacttccagtaccttcatgagagtgttcacggtggtggtgcagagcgcttccaccttattgtcgacggaagtgatctcaggggtggtgcacttagacaggatggagttgttgtatccgatgatgcttaaatcctgaggcaccttaagtccagccttgtctgcatactttacagctccaacagccagaatatcctcagaagccagaaccgcatcaaaatggactccggagcgggaaagcgtgtccagccggtccatggcagcatccagatctttgtggcagagcaccataagctcttcccgtatgagaaaaccggcatctcttacagcagcccggtaaccggaaatcttgtgcagattactgaaggaatttccggaataaaggtaaagcaccgaggatcggccggagtggtaaagccgtaaagtggcatcatagaccgcggcgtggtcgtcacaaaccgtgctgtagatctgttcaccgtcaagacttccgttgaccagcataatgggaaggtcctttgccgcctctattagataggcattgtcctttgcttttgcctctatataatgggaaccggtcaggataatggcatccacccgcttggaacgcaaaagttccaggtatttctttttggtttcaggaagatagccggtgcagcagaggagggaatcataaccattgccccgcagctccttttccagataatagatagcttccgccagccacggatcagaagaatcagcgcacatgatcccaatggttttcatcgtatttaatcccagacttctggcaaatacattgggagtatagcccagttcttccatgacgtccagaacccgtttcctggtcttttcactgacattgggattcccgttgatgacacgggagacagtggcaatggatacgtgagcatgttcggaaacatcgtagatattcaaaaacatcacctccgtaattgtaagtatttacatactcagtttattatacataattctgatagatattacaatccctgatttgtggttttcaaaaaatatcaaaagaaatcccggttattttgtaaacacttacaaatgtttcgcatatacgaaattcatcttgcttttttttggttttcaggagtatactaggacatagaaatggaggcaaaaccatgaaactgaacagaacgacacaaagaactgtggagatcttaaagctgatctccagaacgccccagggggctaccttagatgatctctgcgaaaaactggacttacccaagaccagcgcctacgatatcgtgacgacccttgctgaaatgggtatggtgaatgtgaccagagggcagaagcagaattataccataggtctgatggcctaccgcattggcgttaactatacgaacaatctggactttatcggaatcattgagccggtgctgaaagcattttcaaaggaagtgggaaaaacggtcttttttggaattccgtcggatcatcatgtggtatacatatgtaagttcgaaccggagaatcctattattaccacagctaccgttggttcgaaaaatcctatgtactgcacctcccttggaaaggtgatcctggcctacagcggggaggaagccagggagcagatgatcaaccggctgaaatttactcagttcacagagcggaccatcagaaacagaggacagctccttgaagaactgaagaaggtgagggagagaggctatgcctttgatgcaagagaaatggaggagcatatgcagtgtgtgggagcgccggtttttgaccgggatggcaatgtgctgggagccatcagcatctccagtctttataagccttcggaagattatgaggctttgggaatgctggtttcccaaaagggcatggaggtttcccgtttgttaggatttcttggaaaaatataaggaatacctgttgacaaaatggccggaaacgattaatatttcaggtataggaatcgtaaatatgaagttgattcgtatatgcgaaaataaagaaggagagaagaaggatgatgaaaaaggaacaggttttatcaaggatgaaaaaagactgtctggtagctgttgttcgtgcaaagaattttgagcagggcgaaaaggtagttgacgccatcattgcaggcggcatcaatttcattgaaatcacaatgaccatggatgaaggaaatccaattgaattcatcgcaaaaatgtctgaaaaatatagcaaaaatgcagatgtagtaattggagcaggaacagttcttgatccggaaacagcaagagctgcgatccttgcaggagccaattatgtggtaagccccggcttaaacgttgagacgatcaagctttgcaaccgttacagagtgcctatgctgccgggagttatgacacctaccgaagcaatcaccgctttagagtgcggctgtgacgtgatcaagatcttcccaggcaacatcatgggaccggaagcaatcagctcctttaaaggaccccttccccagggagagttcatgccctccggcggcgttgacgttgacaacgtggataagtggatcaaggccggagcctatgccgttggtacaggaagcagcttaacaaaaggcgctaagaccggagattttgcggcagtcacagcaaaggcaaaggaattcgtcgaggcagtagccgcagcaaggtaaatggcggcgaagccggcagagagggccccctggggcgcgcagataagctaaagctgataataaaaataataacagaattttagggagagaatagaaaatggcaaaacttgtgaccatgggcgagatcatgttaagattatctaccccaaataatgagaaatttatccaggcagatgagtttgatgtaaactatggcggcggtgaggctaacgtagccgtttccctggcaaactatggacatgacgttcagttcgtaactgcagttccggggaaccccatcggtgagtgtgcagtggctgctttaagaaaatacaacgtaggaacaaagcacatttcaagaagcggagaaagacttggaatctattatttagagacaggctccgccatgagagcatctgcagtggtatatgacagggcacattcctccattgcaacggcaactgcggcaaatttcgattttgacgagatctttaaggatgcagactggttccattttacaggaatcacacccgctgtaagcgatgaagcggcagaactgactgaggcagctttaaaggcagccaaggctcacggcgtaaccgtttccgttgatttgaacttccgtaagaaattatggtcttccgagaaggctcagagagttatgacaaacctgatgcagtacgttgacgtgtgcatcggcaacgaagaggatgcagaaaaggttcttggctttaagccgggcaataccgacgtaacttccggtgaactggaattacagggctatgtggacatcttcaatcagatgatcgataagtttaacttcaaatacgtgatcagttccttacgtgaaagctactcagcttccgataacggctggtcagcatgcatcatggatggccagacccgtgaattctaccactccaggaaataccgcgttacccctatcgttgaccgtgtgggcggcggcgattcctttgcagcaggcgtgatctgcggcctggttgacggcaaggactataagggcgctttggaatttgctgttgctgcatctgcattaaagcacaccattcccggagacttcaacctggtaaccagagaggacgtggaaactctggcaggcggcgacggttcaggacgtgttcagagataatttatataaaggaaattttcactgagaaaattatgccaaagagatggggagtcattgggcaatgactccccttttaaaaattatggaggaaagttcaagatgagtgacagaccttttgatttactgagcctgggagaactgctgttacgcctgtctccggaaggtgtggaacggcttgtccggggagattcctttcaaaagcaggtgggcggcgcggaattaaacgttgccgtaggcgcggctcttttagggcttcataccggcgtggttacccagcttccgtttaatgatataggaaattttgtgaagaataaagtccgttcctatggaatcagtgacgactattttgtttatgacagcagctctaatgcaaggctggggctttattattatgaatacggggcatatcctagaaaacccaaggtcatttacgacagaaagaacagctcctttgttcagatcagcacctcatccttcccggaggaaatgtatcaggcagccacctgctttcacaccacaggcattaccctggccctgtgtgagaataccaggaaaaccgctgttgatatgattaagaaattcaaacagtcaggaaccatcatttcctttgatgtgaatttccggggcaatctctggacaggagaggaagccagagattgtattgagcagattcttccctatgtggatattttcttctgctccgaagagacggccaggctgacctttaagaaaacagggaacgttaaagagatgatgaagagctttacggaagaataccctatttccgttgtggcctccacccagagaatcgttcacagtcccaagagccatacctttggatctgtgatttatgatgcttccacaaaggaatattatgaggaagagccttaccataacattgatgttgtggacaggatcggaagcggagacgcatatattgcaggcgccctttatggacttttaagcagcggaggcgactgcatgaaggcagtgcagtacggcaatgcaacggctgccttgaaaaataccatacccggggaccttcccacctctgatttaagtgaggttaatactgttattaaagaccataatgacaaagggccacagagtgagatgagcagataaccttcaaagagaccttgacaccaacaaaaatccagccaggaatgactgaccggacttttgttgttcaaaacaggttttaatttccgcattcaatgctgatctcattaaacttctctaaaatgtgctccacatccacattggacttttcttcccctgctttatcaatgatggcatttccctgatgcatcattatcaggcggtttccgtattccaccgcatagcggaggttgtgagtgaccataacggtggtcagatgcttttcttttacaatcttatccgtcagttccataatgatctcagcggtttttggatccaaggcagctgtgtgctcatctaagatcaggaattcgatgggagtcatggttgacatgagaagggccatggcctgcctctggccgccggaaagaacgcctacctttacatgaagcttatcctctaagccaaggccaaggaaacggagctgctccctgtaataggagatccgctgcttgttggttccgggaagaaggttaaatggctttcccttggtatcagccagggccatattttccaggatagtcatgttggggcacgtgcccattgccgggttctggtaaactcttccgatgcggcgctggcgtttaaactccggcataccggtaatatcaacgccgcccaccagaatggagccgctgtccaagggaatgcttccgcagatgatgtttagcagggaagtctttccggagccattgctccccaccactgatacgaactgctgatctttaatggtgaggttaaagtcctggaacaggcacatctcattgactgttccctggttataatatttattgatgttttgaagttcaagcatgatgtttcaccttcttttccctgccgttgctgaacaccagaatgaccaggaacagcacagacgtgatcagctttaaatccgatgcttccattcccagataaatggccaaagacacgcaggccttgtaaatgatggagccgataatgaccgctgttgtggattttacaaatcccgcccgcttaaacagctttgtgccgatgatcacattggcaaggccgatcacaatggtaccggtgcccatactgatttcaaaaaatcctttttgctggcagtatacggagccggccagggcagccaggccatttgcgatggcaaggccgatgacctttaccatgcctttatccttggccagagaggtgacaagtgtttcattgtcacccacggcccttagtaaatacccggagcgggtctttaaatactggtcaagtaaaagcttaacgattaccacaatgaaagccagtataagcacaacgctgacagctgcaagcttttcggaaaacagaccatttacaaagctgttttcaaaaatagaatcattgttaaaaaaaggaacattggattttccggccacccttaggtttactgaataaagggcagtcatgacaataatacctgacagaagatcacgtacctttaactttacatggatgaatccggtaatgcacccggccagagcgcccacggcaaaagcgataaaaagcgttgccaccgggttgattccggccaggatcagggtaacggtgatagcgcctcccaatgggaaggttccatccacggacagatccggaaaatccagaattttataggtgatgtaaacgcccagcgccataatggcatagaccaggccttcttccaaaacgccaagtatgattgacatggtttatcttcctttcagttattgtgtgatgtctgtaaaaatttcagccgcggagcctgtgagctcttccggaagggtgatccctaaattcccggctacctttgagtttccgtagaatgcggcgtccttgatcacttcaaagttaatttcacttgcctttgcttcgccctttaatacctttgcagccatcttgccggtctgcttgcctaagtccacataatccagacccatggaagccaggcagccgattttaacctgctccacttcactgccgaataccggaatgtttttcttccctgccttatcaagaatcagcggaagagagcttactaccgtattatccgttaaattgtttaagcagtcgaccttttctaaaatgctgtcggttgccaggggaatgtcagcagttgcggtaacagggccttctacaatttcaaagccgtaggcggctgcagcggccttgtattccttgatcgctgtttcagagttcacttcactggtgctgtaaaggatgccgatggtttttgcatcgggaagaatcttgcggatcatttccagctgtttttccactggaagcttgtcgctggttcctgtgatttctcctgccggagttccgtcctcttttgctaaagcagctgctattggatccgtaactgccgtaaaaataacagggacatcagctttttttgctccgctgtaggcggcctgggccattggggttgcgatggcgcagattaaatccgcttttttggaaaggaagttgtttacgatctggcttgcggtgcctccgtcagcctgtgcattttcatacataaccgttaaattctttccttcttcgatcccttcttccgcaagaccctgtaaaaagccttcccggcagttatctaaggaaccgtgctcggcaaactgtccgataccgatggtataggctgcgccgtcttcggagttttcactctcagaggacgccgcagagcttcctgcatctgcactggaagaagcctgggaggtggaattgttatcagaagtattttctggggccgccttggaagaacagccggagagtgcagcagcagctaaagctgccagtaacagagtcttgattgattttttcataatatttcctccttaaaattgttcccgttgacaggacgagaaagtgagccggatggcttgattaaacaaaaaaagtcccaagtacgttaaaaaacgtacttgagacgaatcatacaatccgcggtgccactcaaattgactttataaaagcccacttttcatatactagcatatatgccacgagaaataacggttgtggtctccgtcagcccctactggtacaaggattcagggccgccctcaaaagtccattcagctatcagctttataccgcactcacaccaacggcggctctctgaaatattgcaggaaagcttactcttctttttcaacggtttattattatttcatttaatcagtatattaatacgtctgtatggatttgtcaactgttaatttgaaaaaggcaggcaattgcctgtctttcccaaatgggctgttgtacgtcccgtccgccttttttaccttatcaggcagcgaagcggaggctccgcccgatggtacggaatgagctgtgacctttggtcattgggaatatccgattgaccatgacctcagatggttgctgttaataatccaaaaagcgataaaaaatatatgcttacaggcaaaaaatgtgataaactataaacaacatttattatcggaggtttgtccatgaaaaagttattgatcgtagtagatatgcagaaggattttattgacggctccctgggaactttggaagcggtgtctattgtcccaaaagtaaaaagaaaaatagaggaataccaggcagcaggagatgaggtggtcttcaccctggatacccatgaagagaattatttaaattcccaggaggggaaaaatcttcccgtggttcactgtatcagggaaacttctggttgggaactggatgattttctaaaggagttccagggaaaacgatttgaaaaaaacacctttggcagcgcagagcttggagagtatgtgaaagaaagagagtatgagtccattgagctggtgggtttatgtacggatatctgcgtgatttccaatgctctgttagtcaaggcctttcttccggaaactccggtgcaggtggattcagcctgttgtgcaggcgtcaccgtaaagagccatgaaaatgcactggaagccatgaagatgtgccagatccaggttttataaaaacttttatccatattatcagaacaagaaagaatcccgcaagcgggattctccgcctgcggcgggttgccccagcgacatccaaccctgccgccgcagtgcgatccacccggagggtttttatcgtataggacgaactttcctatacgataaaaagatgccgggctgaacttatgttctcccggcatcttttccagtcataaaatggtgactgatccatttcatctcatcaatctctccaggtcctgatagaactccggatatgaaatattcacacattcagcgcctaaaatctccgtttccccttctgcgcacagtccggtcaccgcaaaggtcatagcgatcctgtgatccagtttgctgtctatgacagcgccgtgaagaggttttccgcctctgatgatcatgccatcctcagtttccgaaacatcagcgcccatggcagataaattcttcaccatgacctcaatgcggttggattcctttacctttaattctgccgcatccttaataatggtttccccttctgcaaggcaggccatggcagcgatcatgggaagctcgtcgatcaaagtgggaatgatggcaccgcctatggtaacgccatggagagagccggattttaccaggatatccgcggtaggttccccggaatccgtattcccatccaaaagggtgatatcagcacccatatcccggcatacgtgaaggatcccgtcacgtgtaggattgatgcctacgttcttgatcagtatttccgagcctggaatcatcaggcctgcagcaataaaataagcagcagaagagatatctcccggcacaacgattttattgccgtaaagctctttggcaggagcgatacaggcagtggtaccttctgttttcacgttggctccaaagtgtttcagcatgatttcagagtgatttctggatacatagggttccgtcacttttgtctcaccctctgcatacagtccggctaaaagaatacaggattttatctgggcggaggccacaggactggaataatggatgccatgaagctttttgccggttatggaaaggggagcgcagccgttttcttttacactctttatatcagcacccatcatggacaatggctccataattcgcttcatgggacgtttctgaatggattcatctccggttatggttacgtcaaaatcctgggcagccaaaaggccggagatcaggcgggtggtggttccgctgttcccgcagtctaagatggtttccggccgttttagtccccggagtccgtttccgtggacaatgacggtgttatggttgttttcaatctgaattcccatttgcctgaaacagctgatagtggaaaggcagtcagctccttgaagaaagtggctgatttccgtggttccctttgcaatggaaccaaacatcacgctgcggtgagagatggatttgtcacccggtatggttatttcgccctttaaaggggaggctttcatgaatttcataaggatcctctcttttaatttgaaattaaatcgtagtggtaccgttccagctgtttccatgcgttgtccatggtctctttgtcatagaaagcaatccttaaagtgccttctccatgctcccggttgtggttgatgccaatgttcttaatgctgatgccttttgcagccaggatgacggataaggtggagatagcacccacttcgtcagccatatccactgtaaaggaataatccggagcaatggatccgggaaccttttctgaaaaggaattgcggtaatccctggaggtttcaaaaagctggtaaataaattggctgtcattttccttaagctcctttaaaatcttgcttaaagaggagatatagcgttccagaatcacggaaagattcccgctgtttgtcatgcagatctgctcccacatttccggtgaggatgaggcgattcttgtaatgtccttaaaacctccggcagcaagccgcttcataatcccttcttgattgtcggaagactttacaaggtttaccaggctggaagctatgatatggggaagatggctgattgcggcggtaataaagtcgtgttcgtgataatcaaggacaaggggaatggagccgatcatgcccgcgatccgcaccagacggtttacctgttcttctgtggaagcagcggtgggggtgataatataataagcattttcaagcaaatggtcggtggagttttcgtatccggtcttttccgaaccggccattgggtgacctcccacaaactggctttccataccaaggcggtttacctcttcatggatatccgtcttggtgctgcctacatcggtgataatggctcccggctttaagaagggctggatttccgacaaatactttgcattgtactccacaggagtgcagagaaagatgagatcgcattcccgaagctcttctccgattccatccaggatgacatctacgattccgtcttcttttgcatgcaaaagcctggaccgggtacgcatgtaggccatgatcgttgtattgggttcttcacgcttgatccctcttgcaatggagccgccgatgagaccaagcccgataaaggcaatggaggcatcactcatgaagttgtcctccccgcaagcctggcgtaaggctgtaattcttccgtcagcttttcaaactgttcaaaggtcagggactgagggccgtcggacagagcgcaggagggacaaggatgaacctccacgatcagtccgtcggcgcccactgctatggcagcttttgagatgggctcaatatacgcccgcactccggtggcatggcttggatcgacgatgataggaaggtggctctttgtgcggataaccggtacggcgctgatatccagggtgtttctggtagcagtttcgtatgtacggatgccgcgttcacaaagcacgatattgggatttccttcagaagcaatgtattccgccgcgttcagccattcatcaatggtggcggaaagtcctctctttaacagaacgggaattcctgcttttccggcttcttttaaaagctcgaaattctgcatgttccgcgcgccgatctggatcatgtccacatattttacggctgtttcaagggaccgcaggcttgtgacttcgcatacaatattaagcccggtggcttccctggcttctttcatgtatttaagcccttcttcctccaggccctggaatgcgtaaggagaggtcctgggcttataggctccgccgcgcaggaactgtgccccggccttttttacggcaaaagctgttttcaggagcatatcgtgattttcaatggcacagggaccggccatcatggtgaggtatcctgggccgatctttgcgtttccaatggttatgacagaatcttccggatggaattttttattcaccagcttgtaggtttcggtcacagcgacgatcttgtctacgccttccagcagttcgatgtttgcgccctgaagctttgttttatcgcctacaacgcctacaatggtcacttccgtcccttttgataaatgggcctgaagtccgtttgattcgattaagtcttttattttaccgacagcttcctcggaagcgttaggtttcatgatgatgatcatatgtttctttccctttcttttgcaaatatttaatccccattgtaatccattggaggagacttgtcaacgcttttacacgttaaactttgacactttaaagtaaattactgccgcggaaggacttaagaccatactttgccagcaaaacagtggaatatttgaagtcattgtgatagaataattagtataacagcagaagcaatagtatttccgcgagaaatgggccaaaggaatatgatgtatatacgtttggcccatgccgcggcagctgagaaaaacctgcatagcgtgtttttctcagctgccggcagaataaatctccggccgggcagcgagtcgctgccgggattttcatggtatggaaaaaggccgtaatctgctgcgaagtacttccgcacattgcatgtgcttccgcctgcggcttgtacgtcttcgcatcttacggcatcaaatttgtattgcttctgttgttttttcgtaaataaaggaagaattttaaaatattactggtatggaggagccgatgtatcagacagatttgtggaaatactgcacaccggattactgcagagacatgctgctatctttccggcttctggggaataccagatggccggaccagaaggtaatggcatgtctttatgcgttcagcaaccacgcggaacgccattatggtattgtattgataccaaaaaagaacggaaaatccaggaagcttctggttccggattacatgctcatgaaaatacagaggaatatcctgcaccacattctggacggatattctgtttccggctgtgccacagcctatcacaagggtgcaggagtggtgtccaatgccgcagttcataggggaaagaacgtggtggtaaagctggatataaaagattttttcggaagtatttcatttccaatggtattaagcagtgcgtttcccgtccaatatttccctacgtcagtagggaccatgctgactgccttatgctgctgcaacgattttctgcctcagggagcgccaacttcgcctgcggtttccaatctggttatgaagcattttgatgaatccataaacaaatggtgcgaaggcaagggaatttcctataccagatactgcgatgatatgacgttttccggtgattttaatccgggcctggttatcaggaaggtttccggctttttaaatgccatggggtttgaactgaatgaaaccaagaccaggattttgtaccgtaacgggaggcaggcagttacggggatcgtggtcaatgaaaagcttcaggtttcccgggattacagaaggaagctgcggcaggagattttttactgtctgaaatacggggtaaaatcccatatagagaagttgggaaatgatgcacggatcagtgaggatcaatatgttctttctcttttgggaaaaatacgatatatcctcctggtgaatcctgaggatcattggtttcaggaagcggaggagaaggttttggctgtacttgggaggaaggcaggataatggatgcaaataaaaatataactctgttgattgcagacgatgaagcggccatccgcaacgggctttctacggtcgttccctgggagcagttcggcattaccatagtgggcactgcagaggatggcagggaggcatatgatatcataaagtcctgcaatccggacattgttattactgatatccgcatgcccggcatggatggactgcagctcatggaacgggtaaaacatgaaaagctgcagactaatttcattatattaagcggttatggggattttaaatatgcacagaaggccattcagcttggtgctaagaattattttctaaagcccattaagatcgatgagctggtgacggaaatcaggcagcaaaaagaagagattctccaatccaaccatattcattcttattccgcctatttaaatgttaaatcagagccaaaggagaaatttttaaaaaggctgttaaagaacgagttttattcttatgaagagatccgggatgaaatccaccggctggagcttaaattaaatgacagccccttccgggtcatggttttttccattgagggaaaagaggacagggaacaggaggatgaattccagcagatcaattatctgatggatattgtgagcgaagagcttcaggaaaccagatatgaatttcttgtgtcaagctccagcgagcttttgacgattatccataccctgcagccaaaggctgtgcccgtgaattaccgcttcctcgcggcccggtgtttaaaacgggtaaaccgggattccaccatggatttaaccgtgggaatcggtaaggaaggagctgcgcttacggattgctccaattcctataagaccgctctcatgtgcctgtcctacagcttttatgagatagaacaaaagatcttcgatgaaaccatcctgtgtaccactccgcctcctgcagccgctaatcagatggattataataatctgatatattctatcacaacgaatcagactgggaaaatacgggaattctgccgggaatatttttctcagcttctttatgtgcccatgccgtcgcccaattatatccgtgggatgtgtatttacttaataacggacattcagaaggcactgggaaacggaaaggagttttctcaggcagaggccgttcttcccattaataccatacggaccttcgaagaattaaaagcctatatggaggattttctcgtagactgtgccggaaagcagggatcaggaggaaacggttctaagaaccagatcattcaggcagcggagtattatatcaaatcccatatgggagaaaagattctggccaaagacgtggcaaggcacgtaaacttaagtgatgtgtattttaccagctactttaaaataaagactggagttaatttcagggattatgtgatccggattaaaatggactatgccaagggccttatggagcggaggccggacatgccggtggcggaagtggccgctgcaatcggctacgacgattaccgttccttttacagggtattcaaacagaacactggtgtcgctccttcggattacaccagaaacagcggaaaagcgccgtaatttggaaaggcagatatgataaaacggttaaaagaaacggtttttaaatttattggagacaaaaagatcgcatccaaaatccggatttgcatgttcagtatcgatatcatgcttactatttttatatgcatttttgcccggggatattttaacaagctttattatgaagaagtggaaatgcagatgcaggataccatgaatgttatttcggaatccttaaataatatgtatgacacgctcattaccaatgtgaacagctttgcctctacacccgccatacaaagagtggtgataagcggccgggaagagagcaattatctaaacccggaaggagtccaggttcagctcatcaaccttttaagcagcaacagcatgattgagtcggtgtttatggtcaatcgggacggaacctgccatacggtatacgcttacggggtaagaccggagaaaaacctttctgatttccttgctgattacggaaccattgatgaaatcacctggcttcccaactgccagagtccttttttgcagcagcaggacgtgatccctattgtgattcccttatcgaccctgattcccggtgataacgtggtgattaccacaaagggggaagaagtggccaccaggctggtggtcctgttaaatttacagaagtttcaaagcaggctgtccttatcaaatgccaattactttgaacgctcttattttgtggtaaattccatggggaataacatcagccttaaaaatcccctttccatgagaatggtgctggaagaccagggttttatcaaaggagtaagggaaaacaacaaggatacccagatccgccagattgcagacctgacggataatgtggtttattcccagatgcttcccttttcggatcttcagcttatcagcgttctttcaaaagaatctttaaacaggaagatcgctgccatgaatcagttcattgttctcatgggcggtgcaggcctgatattttctgtggcattttccgctcttttgtccaaattcattacttctcccctggaacggcttatggagagcatccggcagatccaggagaatcattatgacgagccatataagacaaaatacaacgatgaaatcggccagctgaacacagcggtcaattccatgtacagtaccatacagtctcaaatcagccagatcaaggaggatgagcatgagaaataccagctggagatccaggtcctggcagaacagatcaatccccatctgctctacaatactttggaaggcattaaccttgaagttttaaacaaccacactctggtggcatcttccatgatcaataatcttgggacctttatgcgcattggtttgaattatggggatgagctcatcatgatcagaaatgaaatcgctcatgtggaagcttacatcaatatcatgaatcacaggacaaataagtccatttccttccagtcttatgtagaggaggggcttatggagtaccggattctaaaattgattctgcagccgctggtggaaaactccattaagcatggtttccgggatgaaaagtggggggaagcggtgtgtattccttccattgatgtgcggttttaccggaaagaggactggatttttatagaagtcattgacaatggctgcggtattgatattgataaggcccatgagtccatttaccgggatgaacctgcgggcggtcatcatatcgggcttcataatgtttatacaagattaaaaatctattacggagaagcggagatggactttcagaccattccatatttcaggaacagtgtggtgatccgcattcccgaaaatcaagatgcttaaaagaggtatcccaaatgccgttcaatggcttacgggatgccttctttcatttttttctgccgtctgcaggggtacaatgtttaaaagtgttacatgaatcatggaaaatgtcatgtcatattaaaacggaaatcgttagaataatatcatcaaggcaatacgttatgaaacgttgagaaaggagtaggttatgaaaaaaagagctttaggtttcatgatagcaggagtactggctgctgcatcactgaccggctgttccggtggaggaggaacggctgaaacaactgcggcccagaatcaggcaggaggagctggagagaccaaggagggtacaaaggctgcttcagcaggagaaaccgtgattaaggtatggaccaatgaccgccatgactctgagtatgtggatcagaagatcagcgagtttaatgagtccaatgacaagggcattaagattgagatgactgtggtaacagatgattatgcaaatatgctttccatggcatattcctccggcacggcgcctgatattgcaggcatcagtgctggtcagagcggctttgacttaaagacctttgcagatgcaaaaatcctggagccgatcaatgacagaattacagattcagaatatgagaaggtgaccgaggccagtaagcttcaatacgaaggaatcaacatgatcaacggcaatgtatactggatccccaccggcatgagaagcggcgtaagaatggagtacaacaaggatctggtggaagcagcaggagttaccgagtttccagataccttggatggcgtcattgatctggctaaaaaagtaacggacaacggcggcggaaagaactacggcattgcttttacctcaagcgttcccttcatcagatggatagaaggcacctgtgagacaagcggtatttaccgttatgattataaaaacggtaaattcaattttgacggctataagccggtgatcgaaaagagcaaccagttctttaaggataacagcgttcttccgggatccgtatcccagggtgtagacgctatgagagcacaatttgcagagggggcatttgctctctggggcaatgcgtctcaggaagcaggcgtgtttaccgatcagttccctgtaaccaaatttgactggggagtgtctacggttcccactcttgacggagaagtaaagggtgctttgaccattcagcctcaaaaggggtacatgatgctttcttcttccaagaacaaagacgctgcatgggaagtcatcaagttcttttccagtgaagatttcttaaagggctacttagagggcggctattgccttcccatctccggctatatgagcggagtcattgattcttctaagaccggcagactggcagattttaaattacaggattacgaaagcgtatatccggcagtaccggctgttgcaatccagggtgatgactatgtggcaactctttggaatgctattttaggcaatgtcagcgctgacgatgccattgcagatttaaacaagagatacaacgaagcgcttgacaatgatgtaagcatgggcaagattaaaagacttattattaaggactttgacccgatgcatccaaatgcaggaaccattgagtacttagacaaataagtgcagagagcagaggggctgtttttagaaaaactaaaagcagcccctgttttaaagaaaggtgatacggctcatgaaagaaaaattaagctttgcggaacgaatgaagcgggcaggcagcaggggagattttgcttccgttttgatgctgcttccggcagtgtttttgctggtggtgatatccatctatccattctgctggcttttccgatatattttctatgattacaacgggtttaccgcttactatataggatttaaaaactttacaagaatgtttcaggatgccgttttctggcgcagcgtccttcatacctttgaatatgcggtgatgaagctggtgatcatcatacctttatccctgcttctggctgttttacttaatcagaagatcaagggaagcggaatcttccggggtatttatttcatgccaacggtcataagctccgcggtttacagcctgatattcggctttatctttgccgtttacaacggggtattgaatgcttatctccagaagcttggaatgatccattctcccattgactggcttggaagtgcgtccattgttatgatttccattattattgtggcggtatggggcggcttcggtaactatatgattttgttcatgtccggcctttccagcatttcagaggaagtatacgaaagctgcaagatggatggagcaaatggggtacagtccttcttttatatcaccctgcccatgctcagtcctgttttaaaggtcattttaatgctggccattactacggcactaaaggattatgaatccatcctggtacttaccaatggaggaccaaacagcaggtcagaggtaatgtttacctatatatacaagctgattttcggttcacagacaacgcctcagatcggctatgccaccgtgctcagcattatggcagcccttatcatcggcgtgattacggccatttacatgtaccttgcaagaaaactggatgatgtggtttaaggaggcagatatggaaaagacacataccgtatattcaaaaaagacaaaagcaatgcgaggccttctgttcctgcttcttctggttgtttcgttcatcaccctttacccggtcatttacattgttctgggatcatttaaagcgaataacgaactgcttttgggaggaaccggcatcctgcccaaaacatttatctttgacaactacaagcaggcatgggaaaaggccaatttcgcggtctacactgtgaacagcctgatcataagtcttggggtcatgatattgaccattctgacaaccaccatggccggctatgtgtttgcaagaaaaaaattcaagggaaaagagttgctgtacagcatttttgtggcttttatgtttgtcaacgtaggaagcgtaagcttaagacctctgtttgagcttgccgtgaaggtgaaaatgaacacttctctttaagcatcatcctgatttccactggaatggggcaggcaacttatattttcctggtgaggggatttatgaataccatttccagggagcttgatgaagcggcgaaattggatggctgtacttttttccagatttattataaaataatactgccccttttaaaaccggtcatcgcaaccatcgggcttctttccttccgtacgggttggaatgaatacatcatgcccctggtattcaccatgtccaacgacaagctccgtcccctgaccgtgggtgttgtcatgttaaagaacagcggagacggaacggctgcatggaatctgatgtttgcaggttccacgatatcaatcataccgattatagttatttacatgtgcaccagccgctactttatgagcggactgactgccggtgcggtgaagggataagaagatggagaaattacatttaaacagatcgggctttctgaccaattacctggtatccggcccaagagaaacggattttatcaatcatgaaactgacgacaaccagctgcgctatgagaaatatttaagatcattggttgcagacaaacccatggcaccaccggaaggtactgtggctttgggagaaaccagccgtcttggtatgccatggagatactattaccactatggaaactggtttgtagatgagagcaccttttattccacccttcagaaggtggagcttgatgccgttacgggaatcctggccgagagggatttgacggcaaaggccgttgtatggtcttatgctgcagtgactgtctggtgcaacggggaacttatgtgccatatggagccgccggtttacaaacccattcgtaaggagaccatggagcttcaattaaagaaagggatcaatcagatctacgtcagtctccagaccctgggcgtccgggataccagaaccttattcggaatccagatcaaggaccatgaggctgaaattgctgttgttctgccggatgaggaaaagactgacgaacttgtccgggctgaaacctggcttggctccctttgcttaagggattctgtcatgacttatgagggaaatgctccccgtgggacctggcttgcctatgacagccagagccctgactttgcccaggtggatagcaggaaggagtggcaggagatcagcggcagggataatgtggccctggacgaagaaagacccggtgtgattttagtgagtgtaaggaaggaacatgccgttctcaccagaaaggtggagaatatcaaggcccagaagccggtgtattcgaaggaaaagagttttaaggcaaacagggatgccattttccgaaggatagggaccgcagaaagcttatccagaggagacaagttcggtttttccatttccaatatccttgcaagaaaagctcttggaatggaaaacggaaaggatatggacttactttatgagacccttgaccagattgaaagccggtatgactgctctgattttctagtgtgcggcttaatccggtatttgaaaaattatccggtggatgaaaatatggcagaacgggccaaggaggtgcttcttaactggagatactggatggaccagaacggctccgatgccatgtgcttctggagtgagaatcactccctgatgttttatacctgcgccatgaatgcaggggaaatgtatccggatgattactttccccgcggggatatgaccggaaaggagctgtctgaagcaggcagggcaaaggtggaatgctggctggaggacgtggaagaacatggctttgaagaatttttaagcaccgtatacatgtgcgtcacctttgcagctctgctaaatgtcattgatttctcagagccaaagatttctgaacgcgctgaaaagatcacagaccgcctgttggaaatgctgtgccgccatacttatgacggagtgattatcgctcccatgggacgtgtataccgggaggtagtccatccctttgaacagggagcccaggcgctgatgaatctcatcaatccggaagttccttattcctttggggagggctggctgggctttttcgccagcagcagataccgtctgcctgacggtttgacacggcttatggaagagcctgcagatgaaagttattctacgggaaatgccctgatctgtctgaaaaaaacctcggaatactgcttgacctctgttcagtccccaaggctggatcagggatttaaccgctggaagaatttaactctggacccggatgcagattcctcagcctgtgagtataccaagtccctcaatgaaagattccacggaaccacctgctttgagccgggggtatacggttaccagcagcacatgtggtatgccgcgctggataaagagacggacttgttcaccaaccatccgggaggaacctgtgactccagttccatgcggccgggcttctggtatggaaacggcgtgatgccggctctggttcaaaaggggaatcttctgggagctgtttaccacattcctgaggagcatcccattcattttacccatgcctattttccggttcccaaattccaggaaaccagaatcagggatcattggctgttaggcaggcagaaaagcggatatgttgctttgtggtgcagcggcgtcatggaaccagttgatgaccagctgtttgattgtgaatacaggacctacggggatgatatggcatatttctgcgtatgcagcagcagccatgacgttcattccctggatgagtttacggcttatgcggaaagcctccggccggaatttaataaggaggaacgcactctgacagctggcgggttattagtgaggtttatggagaatcatgataagacacaatatatttagtgaagatactcaaaaggcggttgcttctgcatccgccgttttccgcagccatccctattttatgagcaattacaaatggtgcaaggagcttcttctgaaagagaagaacccggaaaaagcctcagaagccatagaactggggatccggcacgctgaaatgctgaatctggatgcttatatgcttccggtggtttatatagactggatgctgccggaggttcttgaggattcccggaatcaggggattccggaagggatttttctggaatccatgaaggatgttgaaatctggatcaaggtttatcaaaaataccatgagggcaggataggccttgaccagattgaatgggtgttacggtctgtttccggaaaggtgcgccggttcggcagcctgcagtttgaggaggtaacttatgaatttcccttcctgatttttaaaagcagacagaccggcgaatacagagcattggcatgtccaggctttaaggtggatcaggatggttatttttcagggaccaatggaagaagctttaccagggagtatgaaacctatgtaaactgcctggataaaacggtgaccggcttttcggcagatttaaaacagggaatggttaacatggacaggccggtgacccttcatctgtctgactgggagcttcatctggctccgggggaaagggcagtggcagtccatatcccggaaggtgcagatctttcgccggataaaattgattcctctctggaggaggcaaaggaatattatggagaaagcctttttgtctgcgacagctggcttctggatcctcatctgaagtttatccttccggagaaaagccggatcataagctttatggagcgtttttataaaatgcccttaaaggcagaatgtccccagatcctggaacgggtcatggggtttgattgctccatggaaagactgaaaaattacccgtgcagcacttcgctgcagatctcgctaaaaaaatatctcctggaagggaaggagatgtttacaacggcaggtttcctgccgtgaaaataaaacaataaggagaaggggatatgaaaggatattttgcaggattggatattggcggaaccaatggaaggcttaaaatctgcgattctcatggaaccgtacttggggaatttacggcaccgggatgcagtcttaatacggatggagcggagaaaagccggcttcggtaccgggaactggtgctcccggctctgcacgggttaaacctggaaccggggtgctgtctggggatttgtgtggcagccagcgggatcgattctccttcggatgagcatgcttgtaagtccagctttgaagaaatgggatttcctcatgaaaagcttctggtgttaaatgactgtgaagtatttcttcatatgacaaaggaaccggctctggtagtcatatcagggaccggttcggtatgctttgggagagataaaaacggaaccatacaccggaccggcggctggaaccacatcatcagcgatgagggaagcgggtttgacatgggcctaaaagtcttaaaagcggtaggagatgatctgtccggacgaatcaaatgtcccattctcacaccacttattgcagagaaaacagggcttgataccctggaaaagatagacgattttatcaatgcaaatcttatggaaaagtctgaaattgcgggattatccctgcttgcatatgaggcagcagcccagggagaccatgaagccatccgcattcaccgggaatgcggggaggctttgtggggccttattcgggatactgcatccaaaatggaggaaaagaatccggcggacaggctggacctctggctctggggcagtgttctggttaagaatcatttgatacggaagatggtggaagagaaagcagaggaagggctgccgggcgctgtggtggggataccggcgatgagtgccttagatacggctcttaaagcagcaatgtcactgcaataacatgatattgcagccgtagtgtatttttattcccaattctgtgaaaaatgtaaggaagaatcttataaagcggatgaaaaaagagaagatggtcaagccctcttctcttttttgtaattaagaaaatgtctaaaaaatatttgtgcaaattgcaccttttgcttgcaattatatgacatttttagtaaaatatccttatagacttaaataccgaacaggaggaatgtttatgaacgtgtatggaaccaaacaaatccgtaacgtcgccttacttgggcacgggggcgccggtaaaactaccctggcagaagctatggcgttgattaccggagccatcagcagaatgggaaaagtcaccgatggcaataccatcagcgattatgacaaagaagagatcaagagacagttctccatctccacttccctgattcctttggagtataaaggagaggatggaccgatcaagatcaacctacttgatactcccggatattttgattttgttggcgaagttgaagaagccatcagcgttgcggatgcagcggttattgtagtgaattgtaaggctggtattgaagttggaacattaaaggcatgggaactttgcgaaaagtacaagcttcccagaattttctttgtaacaaatatggatgacgatcatgcaagtttccgtgaattgttgttaaagctggaaaaagagtttggaagaaagatagcgccgttccacctccccattcgtgaaaacgaaaagttcgtaggttttgtcaatgttgtaaagatggcaggccggcgttttactgtcaacagtgattatgaagaatgtgagattcctgaatatagccagaagaacctggggattgcccgtgaagcacttatggaagccgtggcagaaaccagcgaggaatatatggagcgctatttctccggtgatgagttcaccattgatgagatttcttctgctcttcgggaacatgtgataaaaggaaatatcgttccggttatgctgggttccggaatcaacgcccagggtgccaagatggtgcttcaggctattgataagtatttcccgtccccgactactttgagtgcatcggcgtggacatttccacaggggagcgctttacagccaaatataacgataatgtatccctgtcagcccgtgtgtttaagaccattgtggacccgttcatcggaaagtattccctgcttaagatctgtaccggtaccttaaagcctgattccgccatttataacgtgaataaggacacagaggaaaagatcggaaagctttatgcgttaaggggaaaggaagccgttgaggtttcggaattaagagcaggagatatcggagcggtatccaaattgaatgtgacccagaccggtgataccattgcccttcgttctgcaccgattgtataccataagccggagatatccactccttatacgtatatgcggtacaggaccaagacaaagggcgacgatgacaaggtttcaaccgctcttgcaaagctgacggaagaggattggaccttaaaggtagtcaatgacacggaaaaccgccagtctcttctttatgccattggagaccagcagctggaagtggttgtaagcaagcttttaaaccgctataaggttgatgtggagctgagcaagcctaaatttgcttttcgtgagaccatccgcaggaaagtggaagttcagggcaagtataaaaagcagtccggaggacatggacagtacggtgatgttaagatgacctttgagccttccggagacttggaaactccttacgtatttgatgaatgtgtatttggcggggctgtgcccagaaactatttcccggcggttgaaaagggaattgccgagtgcgtcttaaaaggacctcttgccgcttatccggtggtgggattaaaggctacgctgactgacggctcctatcatcccgttgactcctctgagctggcttttaagatggctgcaaccatggcctttaagaagggatttatggatgcaaatccggttctcctggaaccaattgcttcccttaaggttactgttccggataaatttaccggagatgtaatgggagatttaaaccgcagaagaggccgcgttcttggaatgaactccaaccacggcggaaagcaggtcattgaggcagacgtgcccatgtccgaactgttcggctataatacggacttacgctccatgacaggcggaatcggaacctttgaatatgaattcagccgctatgaactggctcctggtgatgttcagaagagagaagtggaagagcgggcttctaagattgacagagttgaagtttaaatgaaccgccgcttaaatgattgacaaagggccaaaagcccaaaacccatggcattacctgcttgaaaggtattgccatgggtttttttgtatttgtgtgagcaatgcagggaacggagccgcatcgtcttttctgtcgcctgattctgggcccgcctatggtttttcaaccgttaaaaattaagctgatttaacaaataataagagaaaagaatagatattctgaagattggtacaataaaaagaatgtggtttaaaagaaataaaactaatatattagtataaaaaccgacattatttccgcacattcgacattgttaatatattgaattaaagagaaatgaatcaaaatattttgtgaaaatcatacaaaaaaatcacaagaatattggtacaatacccgtatacaatctgatattttagtactaatatattagtatgagtggtggtttactgccgcttaaggggtggcggaaagcttaaggggctttctgcaggtttctataaactttatttttttaaggagggttcatatgaacgtcaatgttatcatcggcattatcatgattctgtctttcctgggcatggtatggtattgtgtaaaaggcctgaacctcatggtgggatttgcagtcatggcaactttctggacagcgcttgcgctggtggggaattccatttcacccaataccgctatggaaggcaagtcttttattgatgtgctgacctatgtatatgcggacggtccggccgggtacgcaaaatcgattctggtcaacgtgttcttcggagcattcttcggcagggttctggttgatacgggaatcgcatcaacactgatccgtaaggttgttgagctgggcggtgacaaaccgagaatcaccatgggattgttatgcattgttacagcaatcatctttatgtccatgacaggaatcggtcctgtaatctccattgcggttattgtgcttcctatcatgctgtctctcggcgtaccggcgccaattgccatgttcagtttcatggggtccattatggccggtatatttggcaatattgttaacttcaagcagtatcagactatttatgcaggctttaacccggctgcggaaaactatacttacaacgattatttccagatgggagtgatctgtatggtagttgcactggtggtggtgctgatcgtagccaacctatccatgagcaaaaaagcggctcatgcctgggcggcaaaatcctttaccgtaagtgacaatgctccggccatctcctggatttccgtaattcttccggttctgggtgttgtagtttttcagatcccgattatcctgggattctgccttgcaggtatttatgcactgatcactacaggaaagctgaaaggaacctattccgatatctgccggctttttgccaagctgtttaccgatggttccattgatgttgctcctatgatcggttttttgcttactctgtccatgttcaacaacgctgccgcatatgccgcaccgtattttactgcgattctgggaggctttgttccaagaagcgcactgatccttgcacttatttttgcaatcctgactcctctgggcttctttagaggtcctttgaaccttgttggatgcggaaccgcaattctggcagtagtcattgccgcacttccggacgcaccggttgctttcttatacccgctgtttgccataacaaccattgcgccgcagcatctggacatcacccagtcctgggtggcatggggctttggctatacaaaggtttcgacaaaggattatatgaaaatgtccatacccacagggtggatcgtcggctttatctgctgtatcctcgcctttgtcctttacggcggtttgatgtaagccaatgggatactcacaatctgctttgctgcctgatgaggttaaaatatgaagtaaataaggaactggcagggaatgctgccagttccctctttagaaaggaacggtcataataatgggaagatcagtaagaatgggcatcgatgtgggaggcactcatacaaaggcggttgccattgataatgccacccatgaaataatcgggaagtcttcagtaaagacaacccatgacgatcccagaggcgttgcggcaggagtggttaagtcctttcagaattgtctgcgtgaaaatcaaatcagtccggaagacgtagtattcgtcgcccattctacaacacaggccaccaatgcgctgatcgagggtgacgtggctgcggtaggtgttatcggcatggcaaagggcggcctggaaggaatccttgctaaaaaacagaccagacttgcggatattgatctgggaaatcaaaagaaaattaaaattgtcaatgattttttgaatgttaaaaaaatggaaaagtctgcagtggaaaaaactatcagcgagatgcagaaagcaggagcagaggtatttgtttcttccatggcttttggcgtagacgacggaggaccggagcaggaggtctgcgaggcggccggcaaaagaggtgttcccactaccatggcttctgatattaccaagctttacgggcttaccagacggacaagaaccgctgcaatcaacgcctccatccttccgaagatgctggataccgccaattctacggaagactccgtaagagaggccggggttcatgtgccgctcatgattatgagaggcgacggcggggttatggaaatctctgaaatgaaaaagcgccccgttctgaccatgctgtcagggcctgctgcctctgttatgggttctctcatgtatcttcgcgcctccaacggcgtttattttgaggtaggaggaaccaccaccaacatcggcgtcatcaaaaacggccgtcctgctattgattattccattgtcggcggtcatcccacctatatttcttctcttgatgtgcgggttctcggcgtggccggaggatccatggtacgtgcgaacaagcagggtgttctggatgtaggcccccgttccgcccatattgcaggactggattattccgtgtttacggatccggttaaaatcaaagggccaaaggtggagttcttctcccccaaatccggtgatcctgctgattatgtccggatccggctggaggatggttctgcggttactcttactaattcctgcgcggccaatgtgctgggactggtaaagccggagcatttttcttatggaaatgtggaagccgccagaaaagccatgacagctctggccgattactgcggtaccacagcagaagacattgcaaaacagatcatggaaaaagcctatgcaaagattgaaccggtcatactggaactggctgagaaatataagctggaaaaggatcagatttccctggtgggagtaggcggaggagccgcctccctgattgtatatttcagtgaaaagatgggggtcaaatattccataccggaaaatgctgaggtcatttcctccattggagttgccctttccatggtgcgggatgtggtggaacgcattataccctctccatccaaggaagatatccgcgccattaagaatgaggctttaaacaaagcaatcgaatccggagcaacggcggaatcggtagagatccacattgagattgattctcagacctccaaggtaactgcgattgcaaccggatccacggaggttaagactgcagatcttttacaggaatgcgatgaatcggaagccaggcatctggcagcccaggatatgcggattgcagatgaggatacaaagcttctggcaagttcggattacttttatatctatggggaaaatgttgaggacgattctcccagtgccatacgtattgttgataaaaagggatttattaaggttcagagaggaagaggtatgtgcctgaagatcaaagcggcagattatttagatgcgttaaaacagctttgggatgatatggctgtttaccagaccgacctggtgataaggcctgactattatatttgtatgggggccagggtcacggattttgcggcccaggattttgaacagctggaattgctgatcgaactggaattatcatctctggagccggatgaggaaattataattgtaggtgccaacgtaaaacaaaattaaatatttggagacggatatgtcggaaatgatattgagggaaatggcagaaggcctggcacaggtaaatgatctgtcctggggaatgtatgcattctccagggacatcctccgggacaaaatcagtgaagcggaaaaaaagaggatgattgaacttgcgatctgctgcggatatgaaatggcagataaggttatgagcagtctggggacctgggatccctgggaactggcagaaaaatttaagctgaaggtagagtatgcagacagggggcagatagcagacagggtgttatttgccctttttacacctcctgaccagatacagatcatgaaggaacccatagagctggcggcggaaagcgggctgccggaaggcctgctgacaatggatcagatcaaaagtctgatcctgggacatgagatttttcattaccttgaggaagaggaggaggggatctacaccagaagggaaaaggtggttctgtggagattgttgggctacaagagtgaatcaactgtcagggcgctgtctgagatcgccggcatgtatttttctaagaaaataaatggatttctttattcaccatttgcgcttgatatacttttgtattataattataattcaaacgaagccctgaagatgtacagggaagtattaagttattaacgggaggcattcatgggcggcacagaaaacaaccaggaagataccatttatgatgtattgagatccgatatactggatttaaagctgcgccctggaatgatattcagtatcaaggacataagcgagtcctatgaggttggaagaactccggtcagggatgcattgatcagcctttccaaggaggggcttattacatttcttccccagcgcgggactatgatatccaagattgattatgataaggtccgcaatgagcggtttttgaggatctgcgtggaagaaaatgtaatgctggaatttatggcagtatgcaatttaaaggcgatcaccgcattggagatgtctttagacagacaggagcagcttgaaaaaaagaaagatatccgtggatttctggcagaggatatgtattttcattccatcttctacgatggagccaacaaaggatactgcaatgatattctggctgccaactccggccattacagaaggatccggatgttggccatggcggattcaggaattgagccaggggttgtaaagcagcacagagaaatggtggatgccatccttgcaaaggattctgaacggcttcacggagtgttaaaccatcatctgaaccgtctggtcagcaaggaatggcccctggtatccaaatatccggacttgtttgaccgtgaaagccaagagataagaagagaaccggctgggctgggcattgactttcttgtggatacaaaactgaaatatcatgcatagcccggatccggtttgaaataacatttaaagcagtgtcatccccagttctgtgatctcgcaccctcctctggtgcggttgattttaatgaggccttcgtcggaaagctcctttaaaatagaacgcagctttccctcgcttaaaacggttccccgcagggtaagcacttcctttatgccggagcggcctatacggggtgaggcggcaatcagggacagaatggagtttttaacagcactctgtccggacaggggctttttcagccgttttctgatgtaggaaggcagctgggagagtatcaggggatgagccgcataattggtgaaaaagaaacgggtgagatttaggagctcctgaacatttccaggataatcatagcttaacagaaaatccatcaggcttggggatataatatctttcagacgaagattggtatcgtggaacaggttttgaaagaagtgctccattagtaaagggatgtcctttcttctttcccgcaggggaatggtgtcaatggaggctgtgttcagcagaaaaaacagctcttcccggaaggcgccgtttagaacatcctcatataagtcgtgcccggcagtggcaatgatgcggaaattggaaagagggcggctctgaaaaaaaggggtctcctgactgctgttttgcaggacttcaatgagaagatcctgcatttcaagggaaaggagctcagcccgttggatgagcagcgttcctttgtctgaggaattgaggactccggtcagctgatggcctaatgtgcctttttccgggggctcacagaaagaatggaaaactgcaaggggcttctgtcttcggttggaggccctgtgtatggctgcggcgatcatctttttctgtgttccgctttctccctggatcagcaccggaaaatcatagagagccaggcgccgggcatattccagcatgttttttacctggactgtggcggtcaggatgtttgagaaaccattgtttaaaaagtgggcctcctggctgtcagcccgtttaaaggcaagccgccgttcctcgtcctgagacagaggggtatttttgctggtgatcagataaagaggggaatggttgggaagggagagttccaggatgcttaatccgagaatgctcccttttttgttttccagttcataatccgcgctctggcagaaagttaaggaagaatacttagcgggaagtaagtcggaaaactgcttcccgcaggcattcgattcctgaatttccaggtccagggagaactgccggttcatcatggtgatttccccttccgaagagatcagacagatcccctgggaaaggttttgaatgacagcctgcagcagctgatgggaaaaaatataattgctgtaataggttccggtcagcttggtgatctgcaggatgcggttgatgtatccctgggtgatctggttggaaagactggccggtaagtggaagcagacacataattcattgatggtcgagatgtctatgatgcggtttcctatattgactacattttttatataagctggaaccagctgcggctccccaacagtgacggcatattgtatggattcatccgtttcgccgcagcccggataataggggataaactgatactgagtaattcctgcctcccgaaactgttcaatgagggttggaatggattcgcccacatcattaaccagataaactctttcgccgggagggatccggatgatctgatctaaaaacgcatggttaaaggtccgggtacagataagctgcgtcacatcttcaggaacctgaaggggaaaggcgctctttacataggcgctggagaataaaatgcactggtatccagtgatctgggagggcgtatggacctgatagaggtcaatggtatcaaaagagatatatttacccaatatggaatgaagatacgactggaactccaggcgtatggcggcgcttatacatacgatcaaagcatggtatctgggcgttttcagcatcgttttcctacctcctcataaagttattgggcatattatatcaataatgccccttaaaacaacctaaaagattcagaatcttaatttttacagagaggaggtatttgctgccggagatttgtttgacaaatcagaaacgctgcgtataaaatggcttaaaagcaaggaagcttaccggttcaggggcttgccttgctctttttgtataaccagaaaaatgaggaggaaatgctatgaaaagaggatggttaacgttgtggacagcggcaatgctcactgcatcaatgacattgcttacggcttgcggttcttcatcaggaacgcagaaagaatctggcggaacatctgcttccgaagctgcggagactacggccggggcagagggagattcggtttctcaggacatggacgtcaccgctgcggtgagagttgattttacaactatggatcctatggataccagtgataccctttccggcggcattcagcgtatgatgatggacggcttgtttggctttgatgatgaaatgaaaatttatcccatgcttgccactggctacgaggccaatgaggatgccaccgagtttacaatcacgttgagggagggaatttcttttacggatggagctccatggaatgcggaggcagccattgcaaactttacgaagtggggcgataagacgcttgggctaaagcgcaccacatttttatgcaataccctggatcatgtggataaggtcgatgactataccattaaggtaaccttaacatcacctttcggcgcatttatcaataacctggctcatccggcctgtgtgatcatgagccccaaacagatcgaagcggggccgcaagtttgcgcccaggctcccgtaggcactggacaatataaatttgtggaatgggtggcaggtgatcacctgacgctggagctgaataaggactggtggggttatgatccggatatcagcggaggaacagcgctggcagaccgggatgccggctttaaaaccattacctttaaacccgtgggagaggatgcgacccgtgtggctatgatccagtccggagatgcacagatcatatggccggctcccacggaaagcgttgaggcgctgaagacagactccaatgtgacggtaaatcagggagagggcattgtggtatggtatttcatgatgaacaaccaaaaagctcccttcaatgacgtaagggtgcgcagggcagtcagctatgctatcaataaggaagcttatgtccaggtcgttatgaatgggttgggaacgccggctacgtctatcattggtccggcagtacaatattacaagggaaatgatccccttgcctatgatccggcaaaggcaaaagaacttctggcagaagccggatatcccgatggctttacaaccactctcatgtatcagaatacttccgccaaccagaaaaaggctgagttttacaagcagcagctggctgaggccggcatcaatctggaattgaacggtatggaaagcgccattgtaaatgaaaaggttcagggggctaccggcccgggctcagaggtagaggttgagtgttatttatccggctggtctccttccaccggtgatgctgactggggaatcaggcctttgcttgccagggaatcacagccgcccatgagctataacatgtgttattacgaaaatgaggaattggaagagtgcataaaggcaggtcttcagagtgcggatgattcggtccgaagagaggcttatgcaaaagcgcaggatattatctgggaggatgtgcccctggtatgtgtttcgctggattacaatacatgggtgaccggcagtaagctgtcaggagtaaagatctatcccgatggcgccattaacatgaagaatgctaaaatgaccaaataaatggatgtggaatcattgatgcggcgggggtgtcttgttaccagggcacctttgccgcattgccccatagaatcataggagatgagaaggatgctcaagtttacataccggcgcgtgctgggaacgatccccacgctgatcattgtaataacctttgtttttttctttgtaaggatgattcccggtgatcctgcaaggctggtggcgggggagcaggccacccagcaggatgtggaggccgtcagggtccagcttggccttgacaggcccatagcagttcagtatatccggtatatcggaggacttttaaaaggggatctggggaattctctgcgtaccaaacgtccggtttcagttgaaataggggccagatattggaatacccttgtccttactgcaacaagtcttatctggagtaccctggccggtgtgttttttggcgtatggtccggaaaaaacaggggaaaatggcaggactatacgggtatgaccgtagcggtttcaggtatttcacttcctgcattctgggtgggatttcttctgatcatgatatttgccgtaaagctccgctggtttcccacaacaggagcaggaaagtttaagaatctggtccttccctccatcaccttgggcatcagcatagcggcagtgatcgcaaggttcacaagatcctctgtcatagaggttctgaaagaggattatatacggacagccagggcaaagggacttaaggaaaaggccgtaacctggagacatgcctttcgcaattccatgatatcagtggttacggtggtggggcttcagtttggttatcttcttggaggatctgtggttacggaagcggtattcgcttatccgggtcttggatcccttctcattgaatcggtcaactaccgggattatccggccattcagtcactgatccttattttttctttgcagtttatcatcatcaacctggttgtagatatcctttatgcaatcctcaacccggaaatcaagcttggttaagggaggttccatcgtatggctgaaaaaaaggaaataaaaaaaggatcagatataaaaactcctgtatctgagatggtgcgaaagttcagaaggcagaaaaatgcggttacggcgctggtatttgtgctgttcctggcaatactcgctctggtgggaccggttctggcgccttacggcatcaatgaatatgattattcttccattcttgaggggcccggcccggctcactttttcggaaccgatgaatttggcagagatctgttttccaggattttatgcggagccaggatctcactttccatcggcctgcttgcggttacggcgggagcggtgtgcggtaccattttaggccttatgggaggttattacggcggtatgattgattccgtaatcatgagggtttgcgataccctgtttgcatttcccgggatcattctggcgattgccattgtggcaattcttggcagcggcctgtataatgtggtcattgctgtggcggtattttccactcccacttttgcaaggcttgtaagaggaaggacgctgtctcttaaaaatatggtgtttgtccatgcggccagaaatctgggggcttcggatgccaggatcctgttcaagcatattctgccgggagcggtgccggacattatcgtgcagtataccatgtccattggttcctccattctgacagcctccagcttaagctttctgggcatgggagcccagccgcccacgcccgagtggggcttgcttctgtccaatggaagaacctatatgatgaccagtgtccacacgactctgtttcccggccttgccatctttcttacggtcctgagctttaacattctcggtgacggtctgcgtgatgccctggaccccaagcttacggattaataaggaggcggtaaccatatggaagaaaagagaaacatacttgaaattaagaatcttcatacttacttttatattgacagcggaatcataaaatccgtggatggcgtagacattgaactgaaggaaggtgctaccttagggatcgtaggtgaatctggaagcggtaaaagcgttaccgctctgtctgtcatgggcttattaatgggaaccagaggccggattgttggaggagatatcattctcgacggcagggatatcgtacggatcaaagaagaagaaagaaggaaattaagaggaggcaagatctccatgatcttccaggagccaatgaccagcctaaatccggttatgaaaatcggaagacagttgacggaatgcgtgcttcagcatgagaatatttccaggaaggaggcttataaaaaggcagaggatatgcttcgtacgaccggtgttccaagagtagagcggatgatgaaggaatatccgttccagctttccggagggcagcgccaacgggtcatgattgctatggctctcgtctgcaagcctcaggtgctgattgccgatgaacccaccacagctcttgatgtaacgatacaggcccagattctggatctgatgaacaacttaaaaaaggaaaccggaacctctatcctgtttattacccatgatttaggcgtggtggcggagacctgtgacgaagtggcggtcatgtactgcggacgggtggtggaaaaggggatgtaagatcaatttttgcagcacctgcccatccatataccagagggcttctggcttccataccaaagctgggggtttcggttgacgagctggaatccatccccggcaatgttccaaatcccaggttcatgcctgaggggtgcaagtttgcgccgcggtgttcccaggcctttgacaggtgcaggaaagaggaaccgggatttttttaatgggcggaggccatgtgagccgctgctggctttgtgaagggaagggtggtgaggacaaatgacggaaaacctcttaactgttaaggatatgaagatttattatcccgtttccggccgcaaattcggaaaaaccgagtatgtaaaggctgtggatggagtttcctttgaggcaaaaacgggggaggtattcggcatcgtgggagaatccggctgcggaaagtccactctggggagagggatctgcatgctggaagaaccgacctccggtgagattattcttgacggagaaaatatttccggctataacagcaggcagatgcgtccggtgcgtaaaaaggtccagatggtatttcaggatccttatgcctcattgaatccaaggatgtcggtgtttgatatcattgcggagcctctggtcattcacgggctgacgtcgtcaaaggaagagcggaaggatagggtcctgggccttttgcggaaggtagggctggatgattaccatgcaaaccggtatccccatgagttttccggcggacagcggcagaggatcggcatcgcaagggccctggcggtagaacccaggcttatcatcgctgatgagccggtatcagccctggatgtatcaatccaggctcaggtgttaaacttattaaaccagttaaaaaaggaattttcccttacttatatttttgtggcccatgacttaaatgtagtggaacacatcagtgatcgggtaggggtcatgtatcttggaaatttcgtggaggcaggagtcaaagagaagctttataaacatcccctccatccctatacacaggcgcttttatcggcagtaccggttcctgatccggaagtgaaacgggaacgtatcattctggaagggagcattccctccgctttaaatccgcctgacggctgcaaatttcatacccgttgtccaaagtgcatgagtatctgcagcatgaaagcgccggaccggtatcaggcggatgaggatcattacgtttactgccatttatatgatgataaaaccggtaaaaaatgataacagagttaagaggagaaaataattatggatatggaaatgttaggcagactgtcaaatgcctttggtccaagcggctttgaagaagatgtggtgcggacggcggcagggtatttaggcagatatcaggttgaaaacgacgcgatgaacaatttgtatgcctgcatgcctgaggcggagtcaggaaagccagtgattcagctggatgctcatctggatgaatgcggttttatggtgcaatgcatacacagcaacggctgtctggggatcctgatgctgggaggattccatcttaccaatgtcccggctcattccgtgcttgtgaagaccagggacggaaggcttataaagggcattatcacctcaaagcccgttcatttcatgaacgacgaggaacgcagttcccagagccttgacatagaaagtatatatgtggacataggagcctgcagccggaaagaggcggaagaggattttggcatatctgtgggtgatcccatggttcccgatgtgtccttttcttacgacaaggaccatgggatctgctttggtaaagcttttgacaaccgggccggctgtgcttgcattattgaaaccatgaacaagttatatgaggagagaaaggatctttttgtgaatgtcgtaggagccttcgcctcccaggaggaagtgggaatgaggggagccactgtcacaagccagattgtaaagccggatctggccattgtttttgagggctctccctcggatgatttcttctttgatgcggctgtcactcaggggaaaatgaagggaggcgtgcagatccgccgaatggataagagctatatttccaatcctgcctttgtggagtatgccatagaaacagcccaaagcctgggaatcaaataccaggaagctgtccgcaggggaggaagcaccaatgcaggaaaactcagtctgacggggaaggcggttccggtactagtgcttggcgtccccaccagatacgttcattcccattataatttctgtgcaaaagcggatttggaagcggcctgccagttggcagccgaagtgatccgaaggctggatctttctgcgatccgccatatctgccgccaggatctgctgtaaaaccataaaaggagtggtgacttgaaaaaacctgtgatcggtattatgggcaatacatttatgacagaagtgggaatattcaacagcatggaacgggtttatgccaataccgcctacgtggaagcagtactcagaaacggaggcattccggttgtcataccggcaaccgggattctggccggaccggaagaggcaatggcattttgcgacggcctgctgtttcccggaggggaagatattcacccatggtattatggggaggaacctctgcctgttttgggggaaatccggccggaaatcgacgaagctctttttcgggcggggcagtatgccataacccggagcattcccatgcttgggatatgcaaagggcatcagttcttaaatgttcttatgggaggaagcctttatcaggatatttctctgcgggagaaagaaagcctgcagcatatgcagaaacggaaaagaagctatctgacccatcgcgtggaggttttagaagaaacaaggcttgcctccgtactgggggcaggaacgctggaaaccaactccatgcaccatcaggcagtgaaaaagctgggacgcgggcttaaggcatctgcttatgcatccgatggagtgatagaggctttggaggataaagaggggcttattatggggattcaatggcatcctgaaaacttaattgattctgttcccgccatgaaccggctgttttctttttttaacgggcattgtgccaggatgaagagtcaataaggactgtaacctcaattccgcctctttggttaaatcaggctttgcaggctgcccatcgtggaataattgcgcttttctctgatctgtgataaactgataccaactggcaggaggtatgaaaatagtggaagacagaagaagtgcatggaaagcgttttcaagagtgggaatcggatatggagcattccttcttgtgacgattattatacagcttgaggtgggagtcatcgcccttgccctgtcccggttcggaatggaaataacctttgggaactggtatatggtggttgtttctctggctaattacgttgtcgggggaattatcgtctatctcattgtgaaggatatgccggttttatgcaggcccagagggaaaaaggccggggcaggaatgcttgtttccggatttttgatctgtatgagtgccctgtttttggggaatcttattggtcaggctcttatgagccttgtcagcgcccttttgggaaggcctatgattaatccggtagaggaagtgataaaggatttgagtacctgggcgatttttgtcacaatggtgataatggcccctgtttttgaggagatcctgtttcgcaaggtcctggtcgaccggatccggctgtatggagataaggcggcgatcctggtatccagtgttgtctttggtttaagccacggaaatttctaccagttcttctatgcctttggcattggtcttgtgtttgcctatatttatattcagacgggaaagcttcgttataccataatttttcacatgataatcaattttctcggctccattgcggcccttcacattggagataatccactgcttgctgtgggctactccatattcatgcttggggcagtttttgcaggaatcattttgctttttatcagccggagaaagctggtgtttcatccggggcttatggaaacctggggcaaaggttcctttaaaacgctgtttgtaaaccttggaatgatcctgtttttccttctttcggctgtaacctttgtcgtttcttctgcttaatcggaagggtggaatggacagtatttacggagccctccggcacatatttgcggagtgtcctgggatttcataaaatgcggttgacacatttcgtcaattatgttacatttgtagttagcaaaaatactttgattaggagtagtaagctgtctgaaacatgcagagagccggcgggtggtggaagccggttgtggatgacggctgaactggcctttgagtagcgtgctgaaggaagccatgctttctgcgtaggcattgccggtgtcccgaccgttacagcgggcggatatgatgatcatatccagtgagagcatacggacatcgtatgaaatagagtggtaccacgcggcagatcctgcgtctctatggccttatgaacggccggaggcgcattttttatttactcttaaggtcattattttatccgcggacatttaaaacagggaaaatccctttcgtaaaaggaggaagcaccctacgggtatacctatatgcacaaaaagcgtgtgcgagaaggaggaaattttgttatggcagcatcatacaaccataccgccattgagaaaaagtggcgtgaaaactgggcaaagaaccccatcaatgttgatgacggaaagaaacagaaatattactgtctggatatgttcccatatccgtcaggaagcggtcttcatgtaggccattggagaggctatgtaatttccgatgtgtggagccgttatcagattttaaagggacattacgtgattcatcctatgggctgggatgcttttggcctgcctgcagagaattatgccatcaagatgggagtccatccggcgaaatccacggcagaaaacgtcatgaatatcaaacgccagatcaatgagatcgcagctgtctatgattgggatatggaggtcaacaccactgatcccggattttataaatggacccagtggatttttgtccagatgtttaaaaaaggcctggcttatgagaaggaattccccattaactggtgcccatcctgcaagacaggacttgcaaacgaagaagtggtaaacggctgctgtgagcgatgcggaaccggagtcacaaaaaagaacttaagacagtggatgttaaaaatcaccgcttatgcagaccgcctgttagatgatctggataagcttgactggccggaaaaggtcaagaagatgcagacggagtggatcggaaaatcctatggagccgaggttgattttaaggtggacggaaaagaggaaagtattacagtttataccaccagacctgataccttatacggagccacctttatggtgctggcgcctgagcatgctcttgccgccggccttgcttccccggagaataaggaagcggttgagaaatatatttacgacgcttccatgaagtcaaatgtggaccgccttcaggataaagaaaagaccggcgtttttactggcagctatgctgtgaatcctttaagcggtgccaaggtccccatctggctctccgattatgtccttgccgactacggaaccggtgccattatgtgcgtaccggctcacgatgacagggattttgagtttgcaaagaagtttgatattcccattgttcaggtcatctcaaaggatggcaaagaaatcgaaaacatgatcgaagcttacaccgaggccaatggaaccatgatcaattcccgtgagtggaatggcatggagtcctctgtccttaaaaaagaagctccagtcatgatcgaggagcggggactgggaaagaagaccgtaaactttaagctccgcgactgggtattttccagacagcgctactggggagagccgattcccattattcactgtcctcattgcggcaatgtcccggttccggaagatcagcttccgctcacccttccggaggtggaaagctatcagccaaccggcacaggagaatctccgctggcagccattgacgaatgggtgaacaccacatgtccggtgtgcggtgctccggctaagagagagaccaacaccatgcctcagtgggcaggttcttcctggtacttcctccgttacgtggacagtcacaatgataaggaactggtatccaaagagaaagcaaagaaataccttccggtggatatgtacatcggcggcgtggagcatgccgtgcttcatcttctgtattcccgtttctacaccaaatttttaaacgacatcggtgtggtggattttgatgagccctttaccaagctgttcaaccagggtatgataaacggaaagaacggaatcaagatgagcaagtcaaagggaaatgtggtatctcctgatgatctggttcgtgactatggctgtgatgcccttcgtatgtatgagcttttcgtaggaccgccggagcttgatgcagagtgggatgacaggggaattgaaggcgtcagccgtttcttaaaccggttctggaaactggtgacggaaagcagcggtaagaatgtggagcctaccagggaaatgctccgccttcgcaacaagctgatctttgatattgaacagcgtttcagccagtttaatttaaatacggttatttccggattcatggaatacaacaataaattgatcgagttggctgggaagaccggaggaattgacaaagagacgttaaaggcttttgtggttctggttgcaccctttgcacctcatatcggtgaggaactgtggcttcggcttggcggcacgacttccgtattccatgcacagtggccggaatgtgatgaagaggccatgaaggaagacgaaattgaggtcgcggtccaggttaacggaaagaccagagcagtggtgaagcttcctgtaggcgtatcaaaggaagaggccattgaggccggcaaggctttgatcccggataagataacaggacccattgttaaggaaatctatgttcccggaagaattataaacatcgtgtgcaggtaaaaccgtcaatggagtaaaccttaattctattagtatgaaatgtgagggcattataggccatagaaatatggcttatagtgcccttatacagcttcaggaaccaaggaaattctcaatgattgctaagtgtggaatctataaaaggaaatttcggttagaaaaaaattgttgacattttacaaattctatgctatcttttactcaagagttgttactttaagtaggccacatctatcttgtatgatgttgtctgctttttttttgtatatatcatacaagcatttggattggtaatattgaggtcagaagaaaaaaagaaaggagctatatgaagataacgaaagtaattaataataatatagtgcgctcaatgaatgagcgggggcaggaagttttattacttggaaaggctcttggtttccagaaaaaagttggtgatgatattctggatcatgcaattgaaaagatctatatattaaccgataaacagtatgagaatgatttgctttcactgttatcggatgttgatttttccaatatccaggttgttaacaagattgttgaagatgctgaatctacaatgggaagggaattgcctgcaagtgtttatttttccttgctggatcacgttaattttgctgtggaaagatatcataacaatcaaatgtttgagaataaacttcacaatgaaattaagcgtttctatacgattgaatatcatatcggtgaaagagctgtaggaattattaacagcgcgctgaatatacaattgccaaatgatgaagcatcttttattgccatgcacattttgaatgcacaacttgatgataattactttaacaatactgattttatgaccaaaattatcaaccaatccttaaacatagtacgtaaaaatttgaatattgaatttgatactgattcaatcagctatgaaagattcatgactcaccttaaatttttttcaatgcgtttaataaaaaacgaaagattacaggtggataactcaagcattctggaagtaatcaagaaagagtatgaggaggcataccgcatttcattggagatcaggaactatattgagaatacgtttgatgtaagtgttgaagaagctgaaatcatgtatttagcaattcatatcaatacttttatcagaaggaatacgaagaattgaggtggaaacgttgaaaaagtaccggacgattgtgagtggtgccactttccttggactggctgtggcatcttgtgatccaaacaatacgttaattgttgaacggggcaatgtcctgggaagtgactattacacgagccttagaattgaccgcttgggcaattaccaaatgaaagaagcagcaacgaaaaaattgtatcaaagtattataaaaaacaagcatatgtattatgaggatctgttgattataagtgaaatcatgccggttatagggaattttgtaaaagaaatgaatataaatattcttttggactgcacggttatggaaaaagtgcaaaaatcccatggattagcggtggaagcgttttgccgggatcaggtgatgacctttgaatctgactattttattgatacgactgctgataatcttaaactcccacatgaaatgtcgtgttgttcattagtaagaagcaaaggaagtgatccagtggtttgccgtgatggaagccattatgatcttgggaatggcgtatactgcctggagatccctgtgaaaaccgcaagtatgaaagataacaggagacaggtccttgctcattttgaaaaaccaatgaaaagtgaagatgagttattgatgattgcagaaacgccatgcattcgtggaaagtatgaggcggaaagaacaggtaatatcatttatgcttgctcaagtcttacacaaaatgtgtttgaagcaatggacaagggtgtcgaactatggagggatctgtgatgcggacgctgaattggctggcggatggagaatccaaaatgatagaattgaacgaggtaatatacgttgataaatttgacgtgattgtagttggcgcaggaactgccggaagtattgcggctgtcaagcttgcgagcttgggacacaaagtgctcgtaattgaaaaaaagagctttatgggcggcatttattcaagcaccatgtttcagtactatcgggggtccattggtggaatatacgaaaagtttgatgcaatggtggaaaaaatgcaggataagtaccaggtatccaaagcatttggctctcagccaatgattcgccgtgtagtgtatgataagcttcttgaacagtatggggcaaacatagaatttaatgctgttgttgtgagtgtatacaaacaggatcaaaggatagaaggaattcagtatttgacgtgcaaaaaaaaggtcaatgtagaagcaaaagtatttattgatgcaacagcagacgcttcgttatgcaggatagccggtttgacattacataagggccgggagtttgatgggttgtgccagcctttctcaaatgtaaggctgtattatgattttcttgcggatcggatagaattcaataacattgatgccggaactatgaagcaggagaatccggaagagtactcaaaatctgtaattgattccacaaataattcagtatattccaatccgcaagaacaccaattcacattgggaatgtctccgatcattggaatccgcgaaggtttttccatcgatggattaaagaaaattaccatgaaggaaatcgtcgatgggtatatttccaaagaaccgttatattattcaagtgctaatttcgacaatcatacaaaagagatggcatttgaaagcgaacagctttgtgattgggttgttggactgagcatgtggtcagccttgatatccgttcccattgagaaagaagtaatgataccaaaggggattgagaatattatggcgattggaagaatgatgtcattggatcatgatatcgcatcccatacgcgaatgatgcgtgattgtcagaagtcaggcgaagccagcgctattgttattgattctgctttaagaaatgatttgaaattggcagatgtcaaatacagccaaattaaatcgctgctggaaaaagacggctgcctcaatgaagaaaacaattacggattgaaggataacccgcctccggatataaatacgcctatgtggtttccggaaacagattcagaaattgtaaaagcgatgaaatcagataggcctggatttgccatgctggcagcgtatagaggaagaaaaaccagattgctgaaagagggactgcagtcaaataaccagaatatgagggtgaacagcgggattgttcttgctcttttagatgataacaccggtcatgacattttagttcaggctgcgaaaaaacgtgactcttataagccgatgacaagtaagtcatataatatgctgagaggtttgagtgcggtatattgtcttggacgattgcatcaaaaagagagctattctgttttgtaccgtttactgcaggagcatgagtcttttattgacgatgaaatggaatttgataaatttataggaagccgccaggattatcatttccaatacgttgcacatattgtaagagcgctggttaacattgcagaccataatgaagatatgaaagataaagtgacaggcgggatccatcagattgtgtacagagatgattttaaagtatatacgtcactgaaatcaaatcgtaatgatttacatgatatgacatttaagttaagggaatttattcaatggaagcttggtctgcaaggctccgattacgtgaaagcggcaaaaacaggagagattgacaattgcagcaggaagggagaatcatatgattgaacaaaatattattgaacaaattattgaggcaataggtggaattgacaatattgaacgtatcagtaattgtatgacacgttttagagttgtagtttttgacaaagataagatcgacaaagaaaggctcaaagagattcccggcgtacttggtgtagcagggaaaaattacaacccacaagttattcttggtccgggaaatgctgaatatgtccggggtgaagttcaaaaaatgatggatgcccgcgcgcagaaacaggctgttgttaataaagcagatattttcagagaaaagaaaaagaaccgaagcgaaatattcacgatgatttctcaggtgtttacaccgatgatacctgcattggccggaacaggtctgctttatggattgttgagaatttttcaatatattttcatatattttaaagtggatttcttcaaccctgctgcaatcgctgatggggggtctgtatttatggcggcattaagcgttattgcaggatctttcttttcgattatgaatattgctgttgcgtcacaagcggctaaaacaatgggaggcaatccctttgtcggtatggcaattggagcaattgtaacgaatgtgggccttttaaatggtgtatcaatgagcatctttaacttagaatttaaaagtggtatgggtggaacccttgcagccttgcttggcggtttcttagttgcaatacttgaaagaaaattcagaaaagttattccgaatgtcttgcaggtacattttccggcattatgttcaatcttgctcaccggtattgctgtactgtttgtgattcagccaatcagcggtatgattgcaaatgcacttgccaacgttgttatctggcttgtttacaacgcgggagcagtcggaggtgcaattatctccggaacattcctgccgctggttgctttgggaatccatcacattgttactccgatccaaaccactttattacaggaagttggttacacatccctgcaaggattcctttcacttgccggggcaggactggctggtgttgctttaggattacttattaaatatcgcaaacaagaaaaatataaaaaactgcgtgctgcggtaattggtaatttaccgacacagctgcttggtatatctgagccaatgatttatggtatttcaattcctttgtggcggccatttattgctgcaaatcttggcggtgcatgtggcggctttgtattaggccttttcccaggacaaggagccattgccatgaatgtatcggggctgctgggtgcattggttaataccaaaccaggtgcatacttattgagctatctggcggcagtgatcggtgcagctttctttacaaacatattgggagtaaaggatgaaaacatggagattttccttggcaattaaaggcctgtttttaagattccatactgacaagaataaagtgcggttccatgtctggaaacgcactttattcttattatatcataaccatcggctctctcttttttgcagtccatgacaaagggtgcagtttgtcaggttctcattttgtattgcgtttcatgaagtttttagagagcatccgaaaggtatcgatccgtttccgctcattttgatccatgttggcgctcatgatggagatgagaagatctgtttcctggtcattaaactgaatgcctttctggctcgcttccgcatttaagcttaaaagcgttggaagaagctggtcttttggggtggtttccactcgttttgcaaattcattcagcatggatagcttttgcggattcatgttttttagtctggggtcttgtttccagtttgcgttcatagattactgtctttcctttctatggggatatgtaaagggaatcaaggtaggaacaaagattaattcatctgctgcatggcggacatcataagctgcatggtttccaatttggactgttgatccggaggcatgaagttctttagctggtcaaaagacatccgtccaaagggattgttattttgtctttggttattggcaggcctgccgggtccttcggactgggtttgggtttgggactgggcctgggactgggcctgagcctggacaggaatggtggagctgggaacggggtcagggaaagaaccggccagcctaaagccctggaagaagttgataacaaggtcgatgagatcctgttctgccggattggcaaagggctttatggtgttaagcatatcaatgggggagtcggactggcttctctctcctgcggagcagattcccatggtcgccacttctccctcttcaaacagattgatggtgcgctgcagctcgtttatttttacgaagtaggagataaagcgctgttgggaaacactcatataaggcagggcggccttcatcatctgaagatgattatcaccgataagggagtccagatcattggcgcggacattttcttcattgttcatggcatgagattccttacttttcttgttgacaatatatgcgtctgcatatattagtattacaggagagtgatttagatatggaaagcagattgatcatagatggaaatgcagtatatgaaattgatgaagaatgtatgaaaagaaagcagaatagaaactctttaaagggcggaaacggccagaacccttttccaacgtccggaaagggtagcggccagagccgttcataaatgaaaacagggcccgatctgtgaagaagatcgggccctgttttatgttttgcttagcagcagaagttatttccgccaccgaagccgccgccgccacagcagcacagaagaatgatgatccaaatccaactgccaccatcatttccgcaaccgccgcaactgttaccgcaactgttgccgcaaccgccgctaccgccaccacagaagcacaggataagaatcagccaaataagattgaaaccaccgctgttgcatcctccgctgttgcaatcgcatccgcatccacagttagttgctgccagatcactcatataggttcctccaaataatttgtttacactgtaagtgtatgaatgccagcttgccactgtttccacatttttctcaaaatttttagatttgatgtgattgaacttatccaaatgttgtgtataattagaacaacagagaaatgaggagcaaaagatggataaattatattataacagaccatatgtaaaaaactttgaaggggaagtgctggattgcgtccagggaaaggacggtttttttcaggtgcttttagaccggacagccttttatccggagggcggaggccagccggctgatatgggaagcctgggagaggcagcagtccttgacgtaagggaaaagccggaaggcattgtccatattacggataagcctctgaaagcgggcagccaggtaaccggggccatagactgggagagaagattcggccatatgcagaatcattccggagaacatttattatcgggtatcgtacataagcattatggtcttgataatgtagggtttcatatgggaaaggatgaggtgactgtggattttaacggccctctgactctggaacagatagaagcggcagagatggaagtgaatgagctcatctggcgggatattccggtcctggaatcttatccgtcaaaggaggaactttccaatatagattaccggagcaaaaaggaattaaccggacaagtacggctgatcgaatttccgggaggagatgtatgtgcctgctgcggtactcatgtaatgacctcaggagaaatcggcattctgaaggtgacggggatgattcattataaaggcggtgtcagggtgactatggtatgcggacggatggcttttgaggattaccacaaaaaacaaaaggcagtgtccggcatttctgtcctgttatcggcaaaaccggatggcgttctggaagcggttggcaggttaaaagaggaagggtttaaaaaggaaggaaggatcagccagctttccaaagagcttcttgagagaaaggccgcagattatccacaaatggatgagcctctcttggtatttgaccgtgatttgtcaccggtacagctgagacagttttgtaccatgctgtatgaaggaaagaaaggaagcgtggttttggcatgttccggagatgagagagcctttcagtatgcgcttggaagcagccaaaaggacatgagggcattgagcaaagcattaaatggaagattaaacggccggggagggggaagtgccctgatggctcagggaacttttcaggcttttgaggaagagatcaaaaaagcttttttggaagagttataaaaggagagaatgatggaattcaatgacagtacaataaaaaaaatacggggactcattgtatttgccgtaatcgtggtggtggcaggctggaattacagaagcctgtttgccctggccatgaggcttatagggtttgtctcgccctttcttttgggaggggtcatggcctttatcctcaatgtacccatgcgcagaattgaaaagatgctgccggtaaaggaagagagcaggctccgcaggccatttagcctttgccttaccctggtgtttgtggtaggggttctgctgcttgtcatctttgtggtgatgccccagctttttgagacgattttaagtctgcaaaacagcattccgacttttcttgcaagtgtgaaggaggaagcggaaaggctgtttgcccagaatccggagatcgctgactatattaacagcatccagatcgactggaaagcctttttggaaggagtggtcggatttttatccaccggagcgggatcagtgctttcctccacggtatcagccgccatgtccattataaacggagtgacaacctttgtcattgccctggtctttgccatttatattcttcttcagaaagagactctttcacgccagtttcaaaagctgatgaaggcctttcttccggaagcggtaatggtgcggacccttgaaattttaaagctggtctccgaaaccttttccaatttccttgccggacagtgcctggaggcggtcatccttggaagcatgttctttttgaccctgtctgttttccgccttccttatgggcttctcatcggcgtcctgattgcatttacagcccttatacccatgttcggggcatttatcggatgtgccatcggagcatttttgatgctgatggtaaagccgcttgatgcggtcatcttcctgatcatattttttgtccttcagcaggtggaaggaaactttatctacccccatgtggtgggaaattctgtgggacttccttccatctgggtcctggtggctgtcaccatcggcggcagcgccatggggattgtgggaatgctggtgttcatccctctttgctccgtggtgtatgccattctcagggagatcgtaaacggaaggctggaaaagaagaagccgattaaaaacaaaaaaatatagatgtacaacaaaaaaagagggattcatggaacccctctttttactattcaccctggtacatatacttgatgagccgttccacatcctccggatcatgggcaaccagttccagttcactgatgatgctgccattggaaaaaatggtagccatggaaaggtactggcttaatttggattttaaattgatccggtcgccttccttggagaccagctcaacagtgcctttgcactgctcgataaccttaaaaaatttttctacatccgtgatattttgaattttcatgtgaattcctccttttggaatgtccgtgaaataattgtcaattcctacgcctttattatagcagtgttttttctctggtacaatatggaaaaaaccagaaaatgaacgtattccgaagttttttatgtataataagaacataaatgcaaaagaggaggaaaggatcatgaagaggatacgggaatatggtattatcacggggaaactggctccggggccccttaataaaattaccgatgtggaaggggttttggtgggacatgccaccatcaataccaaagatcataaaacaggagtcacagtcattttgccctgtaaggacaatccattctccagaaaactggtggcggctgcctatatccataacggctttggaaagagccagggtcttatccaggtggaagagcttggaaccctggaaacgcctgtggctcttaccaatacgttaaatgtagggaaggtccatgatgccctggtagatttcatgcttgagcagtgcaataaggagggaatagaggtcacctccattaatcccgtggtaggagaatgcaatgattcggtcttaaacaaaatcagtgacagggtggttggcctggaagaagtgaaagcggctgttgcagaggccacggcagattttgaagaaggagcaataggtgcaggctgcggtaccgtatgctatgggttaaagggcgggatcggctccgcctccagaaggtttcaaatcggaggagagacctataccctgggggcaattgtgcagtcaaatttcggaagcacggaaaacctgatggtgaacggaatggctgttggaaaggaaattttccggctgacagagccgtcaattttggacagaggttccgtcatgacgatcgtagcaacagatcttcctgtcacagaccgtcagttaaaacggattttaaagcgggcaggagtagggctgtccagaaccggttcctacatgggccatggaagcggggatattatggtcggctttaccacggcaaaccggataccggaacggccggaaaaagagctgatgtccataagcattttaaaggaaagcgccctggaaagtgcatttattgctgcggtggaagcgacggaggaagcggtcctcaattctcttgccatggcaaaaacaaccacaggccacaagggaaatatagtgcgttccctcacagacctgtggctttccaaggatcggccttagtcaaaatctacatggtagacttgatcagtggtgtgaatgtcaatgacgcttaaattaaactggtcttcgaaaatctggattttatattcaaaaaaggtatcctccgttttctttgacatgaatatatatgcccccggctccttgtcctcaatttcgtcacagatctcgttgtagatttcttccccatccacagggcctttatatccggccgtgcgtatggcttcttcgattgcctgatagaattcttccataaaacagtacctcgtttctgattcatttaaccgaattaagtaagctgctattcggttatgtgcccggtaaagacgggcataatgtgagtaagtggcggagtggattgggaatatccgcttgactatggatactattataagcaatcttttccattgctgcaagaactacttgaatcttcatttagagggtgtataataggagggcagccgccaagatcaggcaagcctggttttggcacgttgcctatacgggaataaaatggagggattggatatggatttgttatacagaccgagaagattaagaacatcagataccttgagaaaaatggtacgggaaaccagagtttcaaaagagtccctgatctatcccctgtttgtggtggatggagaaggccttgtggaagaaatcccttccatggagggccaatatcgttacagcgtggatcagcttccgctgatcatagacaggctgatggaagccggagttggaaaagtcctgctgtttgggattccggcccataaggatatgtgcggaagccaggcttatgacgaggagggaatcgtccagcgggccatccgttttattaaagaacagtatccttctgtatacattgtcactgatgtgtgcatgtgtgaatatacctcccacggtcactgcgggatcctggaaggggagtatgtggataatgacaggactctggaatatttgaaccgcattgctctttcccatgcaaaagcaggagcccatatggtggccccttccgatatgatggatggaaggatcggttccatgaggcaggccctggacagcgcaggttttgtgaatgtgccggtcatggcttattccgccaaatacgcttccgcattttacgggcctttccgggatgctgccggatctgcgcctgcctttggggaccggaagagctatcagatggattaccataacaggaaagaggctttaaaggaagtggaactggatgtggcggaaggagccgatattgtgatggtaaagccggccctctcctatctggatattataagagaggtggctgaccgccatgaccttcctgtggctgcttacagtgtaagcggagaatatgccatgataaaagcagcttccaaagccggttttattgatgaagaaaaggtggtatgcgaatcggcggtgagcatataccgcgctggcgcggatattctcatcacctattatgccattgagcttgccggttttatggacgaagggaagattggctgattatagccccttttcccgccgtatcctcttgatgtcatcaagaagaagaacggatatccgaagacctccccgtccggctcccaagctgatatcaggtttgttgcttccgtgaaagtctgagccgcctgtgggaaaaaggtcatactgtatggccagttttttcagcttgccgctttcatactggttgttggaagagtgatagacctccagtccgtgaagtcccagctcctttaaatagcggaccagttcttctgtttttttatctcccaggtgatactggtatggatgggccaaaacaggggaagccttacagcttgtaaggatcttcatggcgtgctccggagtgatcttttctttgcgggggcagtaagggccgctgtagtctaaatattttttaaatgcctggtccatgttctttacatagcccttttcaagaaggatccgggcaaagtgggcacgggttatgactgtgtcaggatttcctgccatcacctcttccagtgtgatggaaatgccggcattttggaagcggcgtattatttcttcgttcctttttttccggatttccttaagagcatctgtttcagagataaattcccggtctgtcggatcgacaaaaagtcccagaatatgaatttcttcgccctggtaaacacaggagagttcgatccccggaatgatctcaatgggaaggccggcggcagcggcctgtgcttccgaaatgccgtcaatggtatcgtgatcggtcagtgcaatggccgcaagtcccttttctgcggccagagccaccacttcggagggagtgaaggtgccatccgaagcattggaatgaacatgcaaatcgacaaatttcatagaaacctccaaaaagaaatagtttggtaacactatagtaacatgttttttttaatctgtaaaatgtagaaaaaacgcgaaaaataattaagaaaattcataaaatcgtaatagcatttcccacaaagtatggtatactactcagtgtaaagctacaaaatcatgtaaaaaggtgaagttaatgaatcagatagataacagacaaagaggtgggggaagaaccaattcttcccggaaggtcagcagtaaaagtgcatcggaagcaggccgcagaacaggacaggcctacagaacgggcagcccctatcagcagaggcggggaaagaaaagaaagagagggcctcagtacagcgtcacaaagatacttctggggatcattctggccgttgccgcctttatctgcatcatggctgccatgaaggttattggaggaagcaaagctaaggaggcggaggcaaataccacaaccgtttcggagccggaactgaagaaggaagttaaagtggatgggataaccatcaccggcatgtccagggaagaagccaaagaagctattgataaacaatacccgtgggggatgaaggtcacctataatcaggagcaatacgagcttaagaacctgatggataaaaaagtggatgccctgcttgatgagatatattcaggagaaccaaaggaaagctataccattgacttcgacggactggaagaggatgttcaggccgaagtagaagccattgcaggaaaatgggatgtggcagctaaaaacggctccatatcaggatttgataaaaataccggaaagtttatttattccggagagaaaaacggagtagtgatcgatcaggagaagctggcatctgatatcatggcacagcttcaggccaagaatttccaggcagacattcaggccacaggcaaggaagtcgctcctaagataaccgaggcccaggcaaaggagatgtataaggtcatcggcacttatacaacgacaacaacaaccaatagtgacaggaataagaatattgagctggcttctgattctttaaacggcctgatccttcaaccaggagaagagttttccttcaataaggccacaggggaacgttccactgcaaagggataccgtccggcaggcgcatatttaaacggagaattgatcgaagaacccggcggaggcgtatgccaggtgtcttccaccttatataatgcggttgtatttgcagggctttccactacggagcgccatgcccacagctatgaaccttcctatgtaacaccgggggaagatgccatggtcagctacggcgggcctgatatgaagtttgtcaataattcttccacagccattgccatcaggaccagctttgctgacaggaagttaaaaatctccattgtagggatcccgattctggaggagggcgttaccttgtccatgacatcaaagaaaacagcggagttagatgctcccgcaccggtctatgaggaggatcagacccttcagcttggagaggaaaagatcgttaaggcagagaccaagggaagccgctgggtaactaacttagttactaaaaagaacggcgttgtagtaagcgatgagcttttgcataacagcacctaccggggaaaaccggcgaccatcaaacggaaccaatcaggagtcgtcattccggccacggatccggccggctccgctgctgaaagcagtccggcagaatccccgggaagcggggaaaccaccgctcccaacggcaatgagccagacggaaattccggcggacctcagggaccgggaacaacggaaacccaaccttcccagactcagggaccttcttctaccacagaagcggcagatggtgacggaggccagaatgtaattcctccaaacccattcaactaaaaacagattaaaatcagacaggactggacagattattcgttccagtccctttttatcggattgtttcgaaaataatacttaaatttcctgttttaatatttgcaaattgttgaataattgttataataatgtaaggtcactttccctatacgggaaccaatttatacattattcacatttgcaggaggaaatcaataatggcaagaaaaatgaaaaccatggatggaaaccatgcagcagctcatgcgtcatacgcatttactgatgtagcggctatctatccgatcaccccatcttcacctatggctgaagcaacggatgaatgggcaacagacggaagaaccaatatcttcggtcagacagtacagattacggagatgcagtccgaggcaggtgcagcaggtgcagtacacggttccttatcagcaggtgcgctgaccaccacttatacagcttcccagggtcttttactgatgatcccgaatctttataaaatcgcaggcgagcagttaccaggtgtaatccacgtatcggcacgtgcagttgccagccatgctttatctatctttggtgaccactccgacgtatacgcatgccgccagacaggctgtgccatgttatgcgaatccagcgtacaggaagttatggacttgactccggttgctcatatggcagctcttgaaggcaaggtaccgtttattaacttcttcgacggtttccgcacatcccacgagatccagaagatcgaaacctgggattatgaagatttaaaagagatggtaagcatggatgcgatcgacgaattccgtcatcgcgctttaaatccaaaccatccggaattaagaggctccgcacagaaccctgatatcttcttccaggcaagagaggcttgcaacccgtattatgaagcactgcctgcaatcgttcagaaatatatggacaaggtcaatgcaaagatcggaaccgattataaattattcaactattatggagctcctgatgcagaacatgtgatcatttccatgggttccgtaaacgataccattgaggaaactcttgactatctgctggcatcaggcaataaggtaggtgtggtgaaagtccgcttataccgtccgttctgtgtagaagctttcattgaagctatcccggataccgtaaagacgatttccgtattagacagaacaaaagagccaggttccattggtgagcctttataccttgacgttgttgcagcacttaagggaacaaagttcgatcaggtgaaggttttaaccggacgctacggcttaggttccaaggatacaacaccgactcagattgttgctgtttataacaacaaggagaaaacaccgtttaccatcggtattatcgatgatgtgacccatctctctcttgagacaggtacaccgatcgttacaacaccggaaggaaccacaaactgcaagttctggggtcttggtgcagatggtaccgtaggcgctaacaagaactccattaagatcatcggcgacaacacggatatgtacgcgcaggcttattttgattatgactccaagaagtccggcggcgttaccatgtctcacttacgcttcggacacaagccgatcaaatccacctatttaatccgccaggctaactttgtggcatgccataatccggcttatatccgcaagtacaatatggttcaggaactggttgacggcggtgtcttcttactgaactgcccatgggatgcagctggtcttgagaagcatctgccaggacaggtgaagaaatatatcgctgaccacaacatcaagttctacaccatcgacggtgtgaagatcggtattgagaccggaatgggacagacccgtatcaacaccatccttcagtccgcattctttgaactgaccggaatcattccttccgaaaaggcaaacgaactgatgaaggcagctgcaaaggcaacctacggacgcaagggcgaagaaatcgtcatgaagaactgggcagctattgatgcaggtgcgaaaggcgttgttaaggtagaagttccggaaagctggaaaaactgcgaggatgaaggacttgattataagttcatcacagaaggcagaaaagatgttgttgatttcgttaataacgttcagtccaaggtaaacgcacaggaaggaaattccctgccagtatccgcattcagcgattatgttaacggttccacaccatccggctcagccgcatacgagaagcgcggtattgcagttaccatcccaggctgggttccggaaaactgtatccagtgtaacttctgttcctatgtatgtcctcacgctgttatccgttccattgctctgactgaagaagaagcagcagcaaaacctgaggagatgaagacccttccaatgacaggtatgccgggatatcagttcgctgtgaccgtatccgcatttgactgtacaggctgcggttcctgtgcaaacgtatgtccaggaaagaagggtgagaaagctcttgttatggtcaacatggaagaaaactgcgcagagaagcagaaagtatttgatttcggccagacacttccgatcaagcaggaagttatcgataagtttaaagaaaacaccgttaagggcagccagttcaagaaaccccttcttgagttctcaggagcatgtgcaggctgcggcgagacaccttatgcaaaactgatcacacagttattcggtgacagaatgtatattgcaaatgcaaccggatgtacttccatctggggcaactcttctccatccacaccttacaccgtaaatgcaaagggacagggccctgcatgggcaaactctttatttgaggacaatgccgagttcggttacggtatgatgctggctcagagcgccatcagaggcggcttaaaggcaaaggttgaagagcttctgaattccgaaaaggcttctgatgaaatcaaggcagcctgcaaggaatatctggatacctttgagtcaggttcaaccaacggttctgcaactgataagttaattgcagcaatagagggcgttgaatgtgatacctgcaaggcgatccttaaggataaggatttcctggctaagaaatctcagtgggtattcggcggcgacggctgggcatatgatatcggcttcggcggcgttgatcatgttcttgcaagcggcagggatatcaacgttatggtattcgatacagagatctattccaataccggcggtcagtcttccaaggctaccaagacaggtgctgttgcacagttcgctgcaggcggtaaggaaacaagaaagaaagacttagcaagcatcgctatgagctatggctatgtatatgtggcacagatcgccatgggcgctgattatgcacagactgttaaggcaatctccgaagcagaggcatatccgggaccatctctgatcatcgcttatgctccttgtatcagccatggtatcaagaagggcatgtccaaggctcagacagaagagaagctggctgtagagtgcggttactggaacaacttccgttacaatccagctgctgagaagaagttcaccttagacagcaaggctcctgtattagaaggatatcaggatttcttaaagggtgaggttcgttacgcttccttagcaatgaagaaccctgagagagcagctgaattgttcgcaaggaatgaggcagatgcaaaagacaggtacgaatacctgagaaaactggttactttatacggtaatgactaattggctaaataattatttaatagtaatctaaaatacgcccggatgagaaaatccgggcgtaagtttcactatctgttttttcatatacagcatacatgaaaaaataagggagggaatccggattttgcggattctctcccttattttatttacgttgagcaaggataatgatccattgttaacttatacgtttatctggcagaaatctggttacatcgcactgggaagcgtcgcctgaatcaggccgttattgtccagcctggaaagctccatgaccttatccatggacagacctgcagcttttgtaaagcgctctccatactcaggatcagccagatagcagtggaccgcatgacggtatttgatattctctgtgacaggagctatatctccagcagtattttcaatgaggatctgtttcttttcttccgtcagtacgcgccataaatcaccgccggcacggaagcagtcatctgttgggtcatcctttgggtcgtaacggtacatggcgccttccagatccagaggcggttccataacttcaggctgggcagtccaggcaccgtagctgttgggagaatacgcaggagcgccgccgtagttgccgtccacacgcattgagccgtcacggtgatactcattgacttccaccttggcacggttcaccgggatttgattgtggtttacgcccaggcggtaacgttgtgcatcgccgtaagagaataaccgtccctgaaggaatcggtccggactaaagccgatgccgggaaccacgtgagcaggagtaaaggcggactgctccacctccgcaaaaaagttttccggattccggtttagctccagttcgccgacttctataaggggatactccctgtggcgccagattttcgtaatgtcaaagggattctcgtaatggtttttggcctgttcctcagtcatgatttgcacatacatggtccatttggggaaatcgccccgctcaattgcttcatataaatcctttccatggtattcccggtccatgccattgatcttggcggcttcttcgttgcttaagtttttaatgccctgctgggtcttgaaatggaacttgcaccaaaaacgctcattcttttcattgtaaaaggaaaaggtgtgttcgccgaagaaatgcatgttgcggaaggaagcaggaatgccccggtcgctcataaccacggtgatctgatgaaagcattcaggcagcagcgtccagaagtcccagttattctgggcggaacggcggccggtgcgcgggtctcgctttacggcacggtttaaatcggagaaattatgtacatcacggatgaagaaggtgggggtgttattgccgactaagtcccagttcccttcctctgtgtagaacttaacagccacaccgcggatgtcccgttcgcagtcagcggcccccctctcacctgcaactgtggagaagcgaaggaataattcggtctcagcaccgggctgcagaaccttggccttggtatattgggagatgtcatgggtaacggttaatttgccgtaagcaccccagccctttgcatgcatgcggcgttcagggataacctcgcggttgaagtgggccatcttttccatcagccatacgtcctgcattaccacaggtccccgggggccagctgtgagggcgttctcattatcagctactggagcaccaacttcattggttaatttcttgtactcgtcgttcatgataaaactcctttctattttttatttttatgtaaataccaaatgaatacctgtgggaaaggttactttttgacacgattgggattttcaggaaaccagcctttttgcacccgcttggtttgctccttaagctctccgatgctccaaagcatggtgaaacctgttaccgccaatgtggctgataagatgatttgatgggcgaacagtgacaatgcacaaaaaatgagtcctccgattagaaagacaggccatatccgatccgtaaaatagtattggcaatgaatcacgatcggatgaaagataccgataataagaaatgaaatagcgccgattattactcctgaccaaagcatcacaagatcactcctttttattttttatgaaggattgcagttcacaaggataggcacatgaccagcatccataaataaacgcatgtttttggcagcatcagcatgcctattttgggattccggctggaccagagcactaccggaagataaaaaacaaagctgaggataatggcaagccacatgaagccaagacccggcgttatgcttctttgcagaaagaacaatcctgcaaccatggtacccaatagaaaaaaaggcacgttgcggaagattccccagctgaccgggggatgtctttcctgccatttgttatgtggcagaaggcacagcagaatccgaacagcagccagaaaatagatcaggcaggaccagaagcttatgccctttggggagaaaataaggagtccgatttgccatagaaacagataaaacacggtcattgtgattgaggtgatctgctttccatggccaagagcctcaagcagccgttcctcttgatgggtgatgattaccatcatgcggggcaaaaggtgaaaggcatcgccgcagactaaaatcaaagccatcataccggcaagcatggaaacgctgctggcggatctggttaaaagcagcataagactgagggtaaaggcggtaatgagatacagcatatcaaagacagcttcaaaaataccaaatacccgcttcatgattcatgtccctcctttttttgtttagccttggaaatccagaggatgtggagcgttacagcagtgccaatggaaaaaagcataagtgaaatccagactgtttgaattaccaccatggaaagcaccagcattccccataagtagcttaaactgatcgtcaccgttttcctcgaaaggcctgtcctgttttcatagttttctatgtgttctctgaaaaatgaaatacttgtaatccacgctctcagaagaggtgtacgggaaaagcaagcggcagaaaccagaacaaatggggtcgtaggccagaccggcagcagaagcccgatcgctccaagacccaggaataaaaaaccgaaccctgtgagcaaaatgttttttatctgcaattactcacctccttcgattttattttacaaaaaataacgaaattcattactgttatcatacttctaaaggtaaaaaatgtcaatatatagattataatatggatataaagtaagaaattatgaatttcagatggaaatgcctcattaaatgaaatgcaaatcatggcattccctcagattattaataaaaagacagggacttaaagggagacaggcactgggcattaatgaaggaataaacttactatataactatcataaaagagggtttctatgggaattttaacttatatgcagaatgatacggatatggaaacaaatccgccgccaggccccgaagaagacgagtttcccacgggaggagaaaacagtgacattactgatgaaacaggggaagagccgccggaggaaaataatgagatcgtgccccctccaaatctggaaaaggaaacgcctcttcccaatttcccctttcctaatacaactactgatggaaccgggagttctattattacggtatttcccaaacccatcatcccatgctttttctgcggttccggagaatatggacttgtccggttcttaaacgcggcggccggctataatccatttctcgtttatataagcaaccagctggcagtcaatgggctggctaatggggagatgagccagtacggccgggttttggcaggacagcagactgtaatcttaggaggacagaacggatatgtttacttcgaaaagcagattacagttacagttaaccgcgcaatcactgttgcaatcatcaatacggattcaggacttgatttaatggagattgaagatatccattgtaatggggggattaacacaggctgtttccgtgtgtgcaatttatccataacaaaccgcagggtccatgtagcattaaacggcggagttgtaaccttccgcaatgtggattatcaggaagtgaccaacttccagtatgttttaacaggcttttatatggtttccgtgtccaacgccaatgcttccggaggaaatatccttttgaactctaatatctatataagaggcaatgcttcctacaccctgtatgtgtttaactggagcaatgcggaggatgccatccgtatcctgattgtggaagacaggagaacctagaaaaacagaaacctctgattgacaggtcagaggttttttgctatactaagtgtattatgagtattagtacagattaggaggtggaatatgatactgcttgattataaagaccgcaagcccatatacgagcaggttgtggaaaagcttaaggatcttatgatatgcggcgtattggaacaggatgcccagcttccgtctgtccgcgctttggcaacagacttatccattaatcccaataccatacagagagcttatgcagagctggagcgaagagggtttatctattccgtaaaaggaagaggaagctttgtagccgacaccagttccataaaagcacttaaaaacagtgagttgaaaagaaagcttgtgggctggatccaggaagccaaacgggcaggaatgacagaggataaggctcatacatggattgcggaagaatgggtaaaacaggaatatttggcaggggaggagagagcggatgataacagcagagaatctgacaaaaaaatttgatgatattatggcagtagaccatgtaagtgcaaagatacgggatggaagcgtttttggactcattggaaccaatggagcgggaaaaagtacctttttaaggatgttaagcggtattttaaaaccagatgaaggaaatgttaccattgatggagaacagatttttgaaaatgaaaaggtgaaaagccggttcttttacatttcagatgaccagtattattttaataacgcatcgccccttgatatgatggagttttacagcaggatataccccaggtttgacaaggaacgctttcataatcttcttggaagctttgggctggaagccagaagaaaaatccatacgttttcaaagggaatgaaaaagcagctttccgtcatatgcggaatatgtgccaatacggactatctcttctgcgatgaaacctttgacggacttgacccggtgatgcgccaggctgtgaagagcatttttgccaacgatatgtcggagaggaacttaactcctatcattgcttcccataacttaagggagttagaagatatctgcgaccatgtgggtcttctccacaggggagggatactgctttcccgggatttggatgatatgaagcttaacatccacaagctgcagtgtgtgttaaaggatgggatgacagctgaagatctggcagctctgcagcgtattaagacagaagcaagaggaaaactctataccataacggtacgcggaaccagagaagaagtggaagggctgatggaatcataccagccggtattttacgagatcataccattatctctggaggagatattcattagtgagacggaggtggcaggatatgacatcaaaaagcttattttataatttattaagagaagatggcaaaagacgcctttggtctatggcactgtcattcttggtatttttctttacctttccggtgaggaccgctctttccttaagcgaaaggctgagagggcaatatgattatccgtatattgtatccagcttagaacagtggctgggctttcgcaacggctgggtggcggcgctgctcatcctcctgtccctgatcatgggagtgaccagcttttcttatctccattccagacagaaagtggatttttatcacggcattccagtaaacaggaagcatttgttctgggtcaactattttaacggaatttttattccggcagcagtatatgggataaatctgatcatcaccctgggagtggtggcagtaaacggcatttctccttttgaggttttgggatcggccattacgggatttttgctgttcatgatccattacagcatgatgtattctgtgactgtaatagccatgatcctgacagggcatgtcttaatcggcgtttttggaaccatggtcctgcaattttattttgtttgcgtcataggggttctggaattctgctacagccgtttcttttataccagttatcggggcggcagggatgtattcagctattttatggataaatgttcggcagttgtcctgttcctgatgaatttagaacggcttcagccggggactccggcgggaacacaggctgtcaggatctttgcagttttagctgtgacggcagttttgaccttcctttctttcttattatataaaaagagaggttcggaagcggcaggaaaagcaatggcttttaaggtgagtatgccggtgatccggatccccattgtggttctgtcgtcccttagcggaagcatttttttctggtccatgcacaccagtgtgggctgggcggtattcgggctgatttgcggaatgtttttatcccactgcgtcattgagatcatatatcattttgaattcagaaggctgttttcccactggaagcagatggtggcctgcgccttgctggcagcagtgatattctgcggcttccgctatgatctgtttgggtatgacagctatataccggctgaagcgtccattgagtccgttgcaatgtccatgcaggatgcaacctactgggtctcttacggaagcccgcggcaggattccctgggagaatattactgggaataccagaactctgatgactatgcattcagccatatggaactgaaggacactgcaccggttctgtctctggtacgtgatgcggtggccagaaaccagaagctgcaccatgaagatgatggtttcaacgattgggaggatggaagtataaggtatagtttttccataaaatatacgttgaaaaacggtaaggatgtttaccgttcctaccaattatccagcgatgaaatccggccggagatcgtagagatctttgaaaaccaggagtttaagaaagcagtttatccaatccttgttcagacgcttgaggatacttcctgggtcagggtgagcagaggcgagcagaccaatatcgtaagccgtgacagaaacgggacagataaagccatgactgaaaaactgctctctgcgtatcaggaggatctaagaaatttaaaggtggaaaccatggaaaatgaaaatccaatagccaccatacagtttttgacgaaaatgcaggcagaggcggaaacaaaacgagatgaaactcaaagctcctggaagtacagcgatgtcacttcaagaggatattaccccatctacccgtcctttaaaaacaccctggaactgttgaaagagtctcaggttgatgtggaaagctggggtaatctggaacatgtaaaagaaatcaacatagatgccagtcagttttattcctataaatacacctatgaggataagggatcacaatacttaaccatcaccgatccccagcagatcagccagatcatgagcaatgcggtgttggaggaatattccagcatgaatccttttggcagtaaaaaaggggagtgggtcagcttttctgctgttacggaatccggcagaaacagaaatgaggtgggatgctccatctcattggaccggttgccggtatctgtaaaaaatgagatcgaaaagataaaaaaagatgtgtaaacagtctttcattgactttttcttccaatgaagttaaaatggtagaagcataagtcaaaggaggaatcacggatggcattttttgaagagctgggaaagacacttagtgataccggcaaagaggttgcaaccaaggcaaaagcgctgactgaaacgatacagctgaagacacagatcagtgtagagaaaacgaagctggaagaagcttatgcagtcatcggcaaacaattttatgaagcgaacaaagagccggaggaagcttacgcaaaggcttatgaagctgtcagggccagccgggaaagaattgccgctctggagattgaactgacccaaagcgaaggaacccgtatctgtgcggaatgcggagccaaggttccaaagaattcctattattgcggaaagtgcggagcccatgtaaaagaggcatcccagaaagctgatacagaagatgagaatgtagaagaggttgaacagccagagccggcagaggaagtgaatccggcagctggaattaatacggttagtgaagacgcatttgaacagacagaagaacaggaatagttacttaaaaggccggcccttataagccggtctttcttaatatcataggaaaatgtgtcctgtgacagtaaaagcctccggcgcaagagtctgcaaaacaggctttctgttcctgttattttgactttttaaaaaaaagtatgtaaatttcccgtaaaatgtgatagactaaatccgactttgaaaagtactaaaaggcaaagaggtatatcatgaaattatatgtgaagtggcttggaaggatttttgtattttcagccatgataaatgtttttattgaactggccagcagaaaatctctgacaagccttggtctttatatatggggaagcttccctgtttttttactgaacacgctgatcatcacccttccttttacggttatatttgtgacaagacgcaaggcttttgtatgcattaccttatccttgatatggttctttatgggagtggtaaatggcattctgcttatcttccgcaccacaccttttactgcggcggatttccgcctggtgaagtatgcggtcagtctggccacggtttactttacctggatgcagatcattttaatcgtggcaggcatagtgtttgcaattctgtttttagccgcagtctggcgcaaggcgcctgtttccagggaaagagtgaggtacggccttggatccgggcttatagccataggcatcgttgttgttcttggagccacaagcgctgccatgaagacaggattggttgcggttcatttcggcaatatcggagatgcatttaaaagctacgggtttccctattgtttttccaactccctgtttaacaccgggatctccaagcctgagggatatgggactgagacaatggaggccatccgggatgaagaactggttccggagaatacttatgctttgtcagaggatacaaagccaaatgtgatcatgatccagctggagtccttttttgacccttccttgtggaaggacaatccggtaaattatgatcctatccctttttttcatcagcttcagaagaattatcccggcggctatttaagcgtgcctgctgtgggcgcgggcaccgcaaacacggaatttgagtccatcacagggatgaacttagactttttcggcccgggagagtatccttataaaaccgtattaaagaaaacttcctgtgaaagcgttgcctttgatttaaaaaatctgggctataaagcccatgccatccataacaatgaggccactttttatgacaggaaccgggtatttgcccagcttggttttgatacctttactcctattgaatatatgaataatatagaaagaaatcctacgggctggtgcaaggacaagattctcaccggtgagatcatcaggaccctggattctacgaaaggtcctgactttatctataccatttccgttcagggacatgggaaatatccaagctttgagtattactgccagcagatcggggaaatggaccagtttatccgttcccttgtcaacaccttacggaccaggaaggaacccattgttctggtgatgtacggggaccatttgcctggatttgtgtggtcacagcatcagatgaaaaaccgttccctgtttcagaccgaatatgtgatctggaataacatgaaccttcctgtggagaaaaaggatgtagaggcataccagcttgctgcccatgtattggacatgcttaatattcatgaggggacgatgatgagattccatcagaactatttcagcaacccaaaagcagaggaagaaagctatttaaaggatatgaagaccctggaatatgacattctctacggtaaccgggatgtttacggcggagagaatccttaccagtccacggaccttaaaatgggaattgatgatatcataattgaccatgtggtgtacaatgattccaatgttctggtttacggagaaaatttcactccttattccagggtctgctttgacggaaaggctgtggaaaccacctttgtctggccggagcttattattgccaaaaatgttcctgaaaaaaagatgaaggattcggagctttcagtctggcagatcggaagggacaaggtacctctgggacagggagtaacccgttacagggccagggaattgaattaaagaatgaaaggatatgggagagcacaaaatcatatgccctcccttttcgtaattatggtttatataaaacagtatttctgaaagtctgtggtattacagggtgatcagctggtattcctcatttcccaggccgattttcaccgcatgttcaatggaggatctccagttggtgtttggatgggtatctttgaaatggtcatggtgatgactgccgtgcttttccaggatgcttcctgccataacaggctggcggttcaccgcatggacacaggccatatccagggctaccgggtcaaaggaagcaaacatgcccacatcaggaatgatgggaatatcgttttcagagtgacagtcacagtaaggagatacatccatgaccaggctgatgtggaaattgggacggttcccgatcactgcctgggtgtattccgcaatcttgtagtttaggatgtcgttagactcatcaaagtctgtctcaacggcatccacgggacagactccgatgcagcggccgcagcctacacaatggtttatgtctatgaaagcctttttgttttggaaggagatggcgctgtgggcacagttcttttcacaggcatggcagccgatacaggtctcctcggttacatggggctttccggagttatgcatttccattttcccggctctggagccgcagcccattccgatattctttaaggcaccgccgaatccggtgctttcatggcccttaaaatgggtgagagaaatgaagatatccgcatccataactgcccgtccgatttttgcttcctttatgtattccccatcaatgggaaccaggctttcgtcagttccctttaaaccgtcagcgatcaaaacgtggcagccggttgaaaagggggagaacccattctcataggcagtatccagatgatccagggcattcttgcggcttcccacatacagggtgttgcagtccgttaaaaatggttttccgccctgggattttacaaggtccaccactgcttttgcgtaattagggcggagaaaggataaattccccagctctccaaaatggatcttaatggccgtgtatttgttctggaagtcgatctgctccagcattccggcggttttgataagccttttaagcttttgcggaaggttttcctgaaaggtggtatgaaaattcgtatagtaaacctttgatttttccatagaggtctcctttgataagtttatgatatcgctattatactgtaagcaaacagggaattcaagaaggcaattaggactttatttccagatccatttatgataaactaggagaatcatatgactaagttttacaggaggaaaagagatgagtcagaacgggcgttccagagagacagtttgtatccagggcggctggcagccgaaaagcggcgaggccagggtgcttcctatttttcagagcacaacatttaaatatgatgacagtgataaaatgggaagactgtttgatttggaggatgaggggtatttttataccaggctggcaaaccccaccaatgatgctgtggcttctaaaatctgcgaactggaaggcggagtggcggccatgctgacttcttccggccaggcggctaatttttatgcgcttcttaacatctgtgaagagggggaccatgtgatcagttctgccacgatttatgggggctccaccaatctgtttaccgtaaccttaaaaaaaatgggaatcgaatccacgctggtggacccggatgcttcggtggaggaacttgaaaaagcgtttaagcctaataccaaagcagtgtttggggaaaccatcggcaatccttcccttgtagttcttgatatagagaaatttgcaggggctgcccacaggcacggggttccgctgattatagataatacatttgcaactccaatcaactgccgtccgtttgaatggggagcagatattgtaacccactccaccacaaaatacatggatggccatgctaccagcgtaggcggctgcatcgttgacagcggaaattttgactgggagggccatggagaaaggtatcctggacttaccacacctgatgaatcctaccatggcatcgtatatactgagaaattcggcaaaaaggcttatattattaaagccacagcacagctgatgagggatctgggctccattccttcccccatgaactcctttttattaaatcttggcctggagaccctgcatctgcgggttccccgccactgcgagaatgctttaaaagtggcccggtatttaagctccagggaagatgtggcgtggatcaagtatccgggactggaaggggacaaatatcatgatctggcaaaaaaatatatgcccgatggcacctgcggcgtgatttcatttggcttaaagggaggaagggaagctgctgttaagtttatggatggactgaagctggcggctattgtaacgcatgtggcagatgcacgtacttccgttttacatccggccagccatacccacagacagctgacggatgagcagcttgttgaagcaggggttgatccgtccatgatccggctgagcgttggcattgaaaacgcagaggacattgctgaggatatcaggcaggcactggagggataagattaagataagggaaagaaacggcgggaagactgcggtaccagcggttttcccgttttttcggcttagtgggaaaagggatacagaggcggcaaggtgttgcaagaaaaggagacaggctgtataattgaggggatatcatcaatggaatcggcagcatgggaggtgcacaggatgaaacagatcaggagaatgctaagaattatttttggccggactacatttgcggccgtttctcttatcatacaagtggcgattcttattgcgtcataccgttttttgagccgttaccttgcgtatttttacggcggttttgctctgctcagtgcatttgttatcatttatatcctgaataaggaagaaaatcccagctttaagctgacctggatggtccctatcgcggctgttcctgtatttggaacgcttttttacctgtttgtagaactgcagatcgtgggaaagctgatgaataaaaggcttcgcgttaacatggggcatacggaaagctatctgacccaaaaccccagggtcatggaggacttgtccaggataagcaggcagaatgccaatctggctcattatattaaaaattcgggccattacccggcatataaaaacaccaatgtgcagtattttgccctgggggaagccatgtttgaagcgatgaagaaggagctggaggcagcaaaacggtttatcttcatggaattctttattgtggagcggggagaaatgtgggataccatattggagatcctggagagaaaagcgaaggagggagtagaagtccggttcatgtatgacggaatgtgttcccttgtacttcttccctttagctatccaaaggaattgcaggcaaaagggatcaaggcaaagatgttttcccccattaagcctgcatttaccacctaccagaataaccgggaccataggaagatactggtggtggacggccatacggcttttaccgggggatcaacctggcagatgaatatattaacaggcgtgtgcgttttggccattggaaggatacgggcgtcatgctgaaaggggatgcagttaccagctttaccatgatgtttctgcaaatgtggaacatttctgaaaaaggaactgaggattatgggcaatatttaagggacccggaatatttttatcccctggagttaaacatggatggatttgtgatcccctatggggacagccctctggatcaggagaacttgggagagcaggtttatttagatatcataaattctgccagacattatgtacatatcatgacgccgtatctgattctggattatgaaatgatccaggcacttacctttgctgccaaacggggagtggaggttattatcattatgccgcggataccggataaaaaatacgctttcctccttgcaaggtctcattacgaggagctaataagggccggagtccagatttttgagtacgtgcctggttttgtacacgccaaggtatacgcaagtgacgacaccaaggcagtagtcggaaccattaatatggatttcagaagcctttaccttcattttgagtgcgcggtctatttataccgcagtgaggtgatccgggatattcagagagattttcataacaccctggcccagtgccggagaatcaccatggaagactgcagaaattatccctggtatgaggtgctggcagggcgggcattgcggttgtttgcaccgcttatgtagagcgatggggaatgtactgctgtctatggaaaaatgcgtcggaagcatatgcttccgacgcatttttataagatcatggatctttaaaatgacttcatatcagtaattactgggaaacttcaaaaataaccatgtgtgcctgaactggggtcgcaccgtaagaaacggtctgcccagttgtgttaacaagtgcaatggtagatggaatagcgcctacagtaatcagggtaattccgcttaactggcctgttacgatcggcgagcatgatgcgatgccgctgcttccatttatctctaaagaaaattccacataagtggatgggcctgcaccatctgtagatacccaccaggatacatagtaattttgttccgcattaagcgttgcaacgcctgttgttgtgttataagagatattaaggctctggttgtttaaaatggtattgaatataacaggacttccgtttgctactgaagtacctccagtgagctgtaagtcaaatccacgtaactgcgtaaatggtcctgcagggccagtaggtccggtaggtccttgagcaccagtagcaccagttgcgccagtcggtccagtcggtccaacaggtccttcaattccctgtggtccctgaggtccggtcggcccaacaggtccctgagcaccagttgcgccggtagctccggtaggtccggtcggtccaacaggtccttcaactccctgtggtccctgtggtccctgaggtccagtcggtccaacaggtccctgagcaccagtagcaccggcaggccccgtaggtccggtcggtccaacaggtccttcaactccctgtggtccctgtggtccctgaggtccagtcggcccaacaggtccctgagcaccagtagcaccagtagcgccagtcggtccagtcggtccctgagcaccggtagcaccagcaggtccagttggcccttcaggtccttgcggtccctgagcaccggtagcaccagttgcaccagtcggtccagtcggtccctgagcaccggtagcaccagcaggtccagttggcccttcaggtccttgcggtccctgagcgccggtagcgccagtagcgccagtcggtccagtcggtccctgagcgccggtagcgccggcaggtccggtcggtccctgcggtccctgagcgccggtagcgccagttgcaccagtcggtccagtcggtccctgagcgccggtagcgccggcaggtccggtcggtccctgcggtccctgagcgccggtagcgccggtagcgccagtcggtccagtcggtccctgagcgccagtagcgccggcaggtccggttggcccttgtggtccctgaggtccttgcggtccctgtggtccctgggcgcctgtagcgccggtagcaccagtcggtccagtcggtccctgagcaccagtagcgccggtagcaccggtcggtccggttggtccctgtggtccctgcggtccctgaggtccttgagcacccgtagcaccggtagcaccagtcggtccggttggtccctgcggtccctgagcgccagtagcgccagcaggtccggttggtccctgtggtccctgtggtccctgaggtccttgagcaccggtagcgccggtagcaccagttggtccggttggtccctgtggcccctgaggtccctgaggtccttgagcaccggtagcgccggtagcgccggttggtccggttggtccctgtggtccttgtggtccctgagcgccggtagcgccggtagcaccagttggtccagttggtccctgagcaccggtagcgcctgtagcgccagttggtccttgtggtccctgagcgccggtagcaccggtagcaccagttggtccggtaggcccttgtactccctgaggtccctgaggccctactggtccttgagctcctgcaggtccctgaggtccttgcggtccctgaggtccggtcggtccggttggtccctggaatcctctaggccccattggtccggttggtccctgtggtcctctaggcccctgaggtccggttggtccctggcagcctctaggccccattggtccaggacatcctctgggtccctgcggtccagttgggccgcagcagccaccacagccactgcagccgcaattatcgtcccaatttctataattattcattataattccctcctgttaaggtgtgatattgtgattttctgcttataagcattctgtacaagattaaaatcagaatataaagggctttcgtactcctttataccttatcatatgtaccaaatggcaagtttgttagaaagataaatcaacttattaaccccgtcaggatcactgtataggggagggaaacattctggaataatggtatggaaagttctgaatttatagaaatttatgggagaggataaggtctttgtttgcctcacggggttgtcccaaaagaattgtagattatttaacatacagctacagcagattttttcagccttgccctcaccgggtatctgatatgctgtggattaaaaaatgctcctttttgataagagttcaaatacccaggaacttatcaaaaaggagctgcccactgtaaacatacaagttattttaccctgcaggaataaggtcaaaagaattttcatattagataccggtcaatagatattcgcttttatttcatcgatcaaagcatttagccctaattcgttacaatcgttaatgagtcccatagtaataaaaccgccgaaggagtttttggttccttgcttatcgttggaatttaatgattggaccgctttgtcgatcaaattcaaagcctcgttgttgatttcattgtgttgattataatacatggataatttttgcagttcattgagtactttttcattcagtctgctgttcatgatgtttaagacctggctgctgggagcgggctcctttgccgcctcggaatcgtcggtgatctttccatccccaacaaaactgatttgaaggtttgaatcggcactgttttttgaaataagatcgctgattaactcataggcctggtaggtgaattcttcgttattgcacagaaacgaataaattttaccggaaccggtttcaaaatgaatacccttgaattctttttgcttcctttcccagtaaatccacgccgccgggtacaggatcagagccagcaggacaccaatgatacttccagggctggtaccagataaggcaatgagcaatagaataagaacaaaacggacaggaaatggtttgtcaggacagtttcctatccatatatgagaaatattttcggttttgatcatatgatcttcccatctgatcgtattttcttcaatcgctatggtagaatctttaaattttaaattcgtttgattcgccatgaaattctcctctaaacaatttcattattattaactacaacagatgcaatgagaaccggatttgtgatcgaaatggtaccggtggtatcaaagctcataatttctacatatacgctgtaattgcagcacttacatcccatggagtcacagtcataagccgtgaaagaaaaggtatttgtttccccgctgtctgaatttctgctgtaaaccagactggaactgacaggtgtggaaattgtctggccgcttcctcgcttaaacagctgaaatctaagatgcatgcgggcattggtggtggcgatattacaggaaaaattgaagtggatcaaaaagttcctgtagctgcatgtatccatgttaagcgaagctacgttatatgtagcgttcttatctgtattttcaggtaaaatgattcctcctaaagcagaactctttaataaaagctggtttccaggggaaggctcacaggtgtttttttgaatattttgaatactttcgatgtggttgtctttttttggcggagcaggctgagggcttctgtttactgcattatgatatggacaattgggacggcatggtatactcatactgaataggcggttatacataatgaccccagctccttatttgaatgctcatagatagagcattcagcctggttcagccaaataccctatctatgaaaaaagttagtttatgcagctattggacaaacatcccctcgtacccaccgtttaaagttggaattaaaagcagtcgttatctacgatgattgcagcaagagatgcattgttaatggcagtaacgcctaccgtagcaacgccggcaaccgtagcgactacgctgtaagtgcagcagtcatcgccgcaggtatcacaatcgcaaacgaagaaggagaaggtgttactatcagtaacagcaacaagccgtgagaacgtccagatcgatcctacgggaataggagtcagctggtttctgcactgtttgaatatctggaaattcagagtgataacagcagcagtcgtcacgatattacttgcaaattcaaatttaatgcatgggttttttaagccttttgaatctacggttacagtggccaaggtaaaagttgctccggcaaccgttgctactggaaggctaacgctgccttggctgccgcattttaacattgttctgttgggtttaaggtactttttgggccgttcgcatgtgcagttacagttgcacgcacaatcctggcattcatcacattcgcaatcacatattctcatatcaagatcattcatgatgtggcctccactttacttaataaattaggaatatttcgttataccatcatggtatactacattatattatcaagaaaaaaatgtgctacaactcaatagacaatatcttgtacggctgtcatctattggctgatttgaggcatttatggatttgatacttgaaaaattttgctgcaagacttcaactgtaagtaataattctccgttcataaataattaaaattctgctttcttcaattaccggatggttaaaaccagatctttgttcttcatggtgaccaataaccggtatacatcatgcttccatgaaattttcagacgttcatcggtgatgggaattacctctttttgtattttggatgcaccttcaatgaggaaactgcctaagtttcctactttaacagtatctccatttacaaccggctcctcataaaacataagtgataataccggatatggaagatcccctcatagtgatcggaaatgataatttcctttcccttattaagtacagcgttccgggtataagatctgatccgctcatccgggtaggcggcagctaaatccatggagatccggcagtcagaagctcctaattggtgggtcacgttttccgcccggtaatcagctccatccttttgcatgatctgggtttttccgtcaaaaaaggtggggaggttatgatagcgggactgcatggtccagatgtcataacggtcttttgaaaaggtcttctttgtataagtttccactcccacatcaataaacatgggatttccatccttgtaaatggtaaagcttcccgtatcattgtggttatggctgtcgtcattatctccggcttttactgcaagataaaggtggctctctctggcaatgaaaagtcccgcgctctcataccagaaatcccggtggacaatgggggatttggcaaaggaaaccatttcctgatgggtaaagactgtctgcaggcggtaaaataagttatgttcctctgctgttaagggatcttcgctgttttggtaatcccatgcggcaaaggacataagttccttattgccggtccgcctgccaaacaggaattccctggctccgcaccgcccggcaatgggagagcagtcagcaaagttcacataatagacatcatcgatgtgggcggtcaggatataagaagcaatgttcttgattttcccgatctcatatgcagggagaaaggcattgtctgatattccgtttaaaacctccaggcagttaaacaggcaaagcccggcgtgacggtaatactgggctccttcgtcacagcagccgtcttccccgtactctgccagaaaatagtcaatgcttttgcatgccttttgaaatatgttctccttttggatctggggaagttctcttgtaaaggcggagagaagaacgttctgggtacaccagaccgtccagttgttcatatggctgtctccatcacccatccaccagaaatgttcgttaagataaggagtgaagatccgttcatcaagatttttattgatcatctttgaaaggaagggagtgacggaaagaagctcctgccttaaaagatattccgtcactgacaggactgcggctgtttccgctgcaaagaggtcgatcacagggcgggtgacatcgggaaggataaagggaggagtatcccggatgtaggaattgtgggcaggaagctgccaggcattttcctcacagatcaaataaagcccgttgatgatgtcatcaaggaaacgtcctttatattctgcacattcagccagaaccagggcatccagaacagtccttcttaaaaacagcttgtcctggaaacggcttctgttcccatttcttgtaaattccatataatctgctgcggtcagggaaggataatcaaagtttaaaaaggtttccccgcttttaatgagacggcttttaagatcctccggaagagaatcccaggaactccggtcagaggcctggggaaagggggtaaagcttgataatggtttcttttggtcttttgcaagttctgtgatcatgatgaatactccttatttgttttcgtcaggattgacggtattttgctgtataaattcccggggagaaagcccggtaacttttttaaatactttactgaaataaaaggcgctttcaaagcccagctgatcggctgcctcatagattttcatgtcctgttccatgaggagggctttggcccggttgacctttgcctgggcaatgtattctgaaaaaccgacccggcagttcttcttaaacaggatgcttaaataattggggcttaggccgaacactccggccacttcgtttaaggtgagcttttcggatatatggttgttgatgtatttttgtacattggtgatgacgtgggctttgtaggttttccgtttggaccgcaaaacgtcgcaaaggccgtcacggaagatcgtcatccattctgcgatctgctccacattggtaaagcggtaaatggaacggtagctgtcgctgtaggaggaaaagatctccgtcatattttcttctccgtcaggcagaagagagagggccaggtaaaggatgttgcaggccccgtccgcagcctgggaaaaacgcaggggatgggcttcaaacagcctaatgatttcagtcagagtgcggtataagatatccgtatcaaattcattaaatgccttggttatttcatttttaaatacggaaatgttgaaagcgttgcggatggaggccgcatcactgccggtgaacatcacgacaggctgttctgaggaggtccgcccaaaggcctggcgggcttcctgataggactcgctgatcttcatgggctggctgaccggagttccgattcctgtgagaacggtcacattaaaatagttgcggatcatatcggctgcgttgcgaaatgcgttaaaaacagcctctttccggtagtctgcctgatcgggaaggtgaaataccactgcaaaatgtttcatatccaggcttaccacataggcgggaagatgtctgccgatgatttcctttgccatttgcagagcgctgttatagaggttcatgagctttccgtgatccatatccttacgggcttcctcccgtatctggcaaagggccgtgaaataacagttttccgaaaaatccagtcttaaatccctggactggagctcaaactgttcttcgctgtcaaagaggttatgcaggagccgcatgaaaaatttttcataatagctctgcaggagagggcggccggaatccttatattccatggaaacctgaagggtctccaggcgggaaagggcctttttggctgcctcggacagggaatcggcatttagttccagcttgattagataatccaccgcttcataggacatggcttccttgatgagctgaaattcctcgtagctggtaagaaaaatgaacaggggtattttaccgtatgtttcccggcaggaccttgctaagtccagtccgttcatgatgggcatgcggatatcggtaatgacaatttccggtgagtattctgctatcatttccagagcatttttaccgtttacggcggtaccgcagatttcaatgccgtaatccgcccagtttatcatggattttaatccgatctgaaccaaaggttcatcatcaacaattaatagtttagtcataaaattaccttcctgctgatttcttttccgaatgaagcacgtaaggcattaagatggtcatagtggtaaattcgcctggcctgcttgttatggtgatgccatattccgggccgaagtcgtgcttaattcgtttattcacgttgctgatgccgacgtgccggaaaaattctgttttgttctgattgtcgtcttcctcacaaagaaccttgcggatagcctcctgggacatgccgatgccgttgtccgttatgcttattttcagcgctttcttccggtaaccttccgttgtttcggcggacactgtaatctttcctgcggttcctgtgggctcgatcccatggaacagggcattttcaatgataggctgcagggtgaagcggtggatctggcagtcgtataaagcttcagattcaatgaaatactctatggttacactgccgccgtaccggtactgctggatcagaaagtaatcctttaccagagccagctcatcccttaagggaatcatggaagcggttcccttagatacgtttttaagaagccttgccagagcagtggtcatatccgcgattccgctggcattctggatggtggccatccatttgatggaatttaaggtattgtataaaaaatgaggattgatctggctctggagaatctggtattccagatcctttctctgcttttcatcatccacccgtttttccatcagcgtgacgatgttttctgacatgctgttgatgccccggccgacctgtcccaattcatggttccattcgatggaattgtccctggaaaaatctccggccgatatatcggctatcttgccgctgagcctgtgaatgggctccatgatgatcctgtttaagagaaaggccagcaagaccccaagggaaacgatggtgagacagatggcgaagattaaaagggtatacagcagcttctgctgaccaaactgctgctcggagagaacattggttaagctccagccttccattccctccaccgggcgctccaccaggatccttttttttccatcgtccatagtaacggacagaacccgggtgcctttggataaggaatcacttttggttaattgcaccggatccgtatagggtgtcccgatctcctgccatccaccggactttaagctgtaggacttccctcctatggtaataaaaagcatgctgtccgaagggaggggatagtgtgctaagtaatcggtaaacaggcgggaggagatttccacataagtccagcctatgatttctgtactgaattcatcataaacaggccggacgatgggaatgtactggtcccggctgatgctggagaagggatcgtttacaaagccgatccataaataatctttagaatcataaagcttttgaaaaaaatcggtctggctgataatacgtgccgcataagaggaagagttgttggccaacgcggccatttgaaggaaattatttttattatttgtggaaataataacccttgacatgtattcgtatgcccggttgtagtaatattcctcttttaagcggttatggctggaaagggccgtagggcgtaaattttccaggtccgttgagagtgtgggcagcttttgataattctgaaaggcttccagatagtctaaaatggcaccgttggagcagcaccatttgctgaaatagatgatatccttcatatcggatgttatgttgttgcttacgacctgaaggctgaattccgcggactggatctgatttttccttaaaaaagtctggaaaaccgagaaacataccgttgtagtaagaacagtgattaacagggtaacggcggctgttagaatcatgattttgcctcttatggtctttggtaaaaacattttccacatggtaaaacttaccccttccttatatattgcaacataatgctgctgcacttattatctacaaaggtagcttatttattgtaaaatgtcaatgaaaaacagcgtggttttttgtgaaaaagtgatatattgtatacaagagagaaattttactgctaatcataaaaaaatacatgatttaacaaagtgtgaaagaaatgtgaataaaaagtgaatattttattagataaattccattcttaaaaaaacagtcaggggttataattcagatatggtaaatcacatgtaaaaaatgcgcggtttactgaaaacaaattcaaatcaggagggaatacaatgaaaaagagaacactcagcattgcgctggcatgtgcgctggcagtgaccagccttgctggctgcgccggcggcggtggcaatgaaaccactgcagcggcttcggaaggggataaggcggagaccactgcagcggaagcgaccaccggggccggaggacagactaccctgaaatggtctgtatgggatatcaatcttgcgccttattatcagccgcttattgatgcttttgaagaaaaacatccggatgtcaaaatcgagatggttgatttaggctccagcgattatcagaccgttcttgctacggagcttacaggcagcggttcagatttcgatgtggtaatggtaaaggatgttcccggttacatgactctggtaaataaaggtgtattggagccgctggacagctacattcagtcttccggtgtggatttaagtctgtataaaggcctgaccgatcagattaccattgacggcaaattgtatgagcttccgttccgtaacgatttctgggtactgttttataataaagatgtctttgacaaggcaggagtgccttatccaaccaatgatatgacatttgaggaatacgatgccctgacaagaagcctggcggttgagaccccgggtcaggaggtttatggttcccactaccatacatggagatctgcagtacagctttttggtgttctggatggcaagcatacgattctggatggcaagtatgagttcttaaagccatattatgaaatggtactcagccagcaggaagacggaatctgccaggactatgcaacgttaaagacaagcggtcttcactattccggcgcctttgcacagggcaatattgcaacaatgaacatgggcacatggtttatttccaccttaattgaaaagatcaaaaccggagaatataccaactgcaccaactggggaattgcaaaatatcctcatgcggatggcgtagaggcgggttctacccttgcaaccattacttcccttgcaattcctaccaatgctcccaataaggatctggcctgggagtttgtaaattttgtaagcggtactgaaggcgctgagatccttgcttccacaggaacgattccggcagttatgaacagtacggtggctgatttgatatccaatacggaaggattcccgaaggatgacgataccagcgtcgatgcactcaatacagcgaatctgtatttggagatgcctgtaaatgcaaagaattctgaaattgaaaccgcattaaatgaagctcatgacgcgatcatgacaggcggcatgtccgtagacgacggcattgccgaaatggatgaaaaagtaagcgcaattctggctaagtaataagccgaaagaaataaaacagaggcgggcagcaagaaggcccgcctcatttaaagaaaatttctgatttgattttgatggaatgaaaaaacgagaaaaggaggataagccgtttcatttggctttcattataaaatatggctaagacaataacagaagcgcaaagacaggaaaaaatcgtggctttaaacgagaaacgggaagctctgagccttttgctaaaagatgcccggggaacccgaaagcgcgatgggctgattgcgaaaatcgagacaatagatgagaaaataaaaaaagtgcggacaggggaacgtttcacacgtcaggaaaagagggatatgatcgcctattccttcattgccctaatttcattgggtttgcagtctttacactgggccccattatatttgcctttgtcctggcatttatgaaatgggatggaaacagccccatggagtttgccggacttaagaatttttttgatatgtttgtaagcgccaggttccgggcgtcctttaccaataccattgtatactgtattgcaacggttcctttgacactggcctgtgccttaggtcttgccgtggttctaaaccagaagataaagggaaggaatttcttccgtaccgtgggctttttcccttacgtggcatctttggtggcagtggctgccgtgtggaatatgctgttcagtcctcagaaaagcggcccggtgaacatgatcctttatcacctgggagtccatgccaagagccttccaaagtggtccgcagatccccactgggtgatgtttaccattgtattgttcagcgtttggaaaaatatgggatactatatggtcatatatctggcaggacttcagggaatcaacggagagctgtatgaagcggcaggccttgacggctgcaattcctggcagaaattccgctatattacctggccccagcttcagcccaccaccttctttgtgaccattatcctgaccatcaactgctttaaggtttacgatatcgtttacatgctggcaggcggttccaacggcattgtaagctctcaggcaatggttcttgtttaccacatttacgaagaagcgttccgcaactggaatttaggctatgcaagtgcggtagccatggtattgttcttaatggtgctcgcaatcaccctggttcagttccgcggtgagaagaaatacgcaaactaagataaggaggattaagaaatgaaaataaaaagcacaagttataaaatcagcagatgcctcctctacgtggttttgctcattctgacagccgttatgctgattccttttgtatggatgatgtcggcttccttaaagcttgacaaggatgtattcatttttcccattcagtggataccggaaaatccaagatggcagaattatctggatatctggacaaagatcccgcttatgacctttgtacttaatacggtaaaaatcaccctgatcgttacctttttacagcttttaaccagcagttttgccgcttatgcctttgcaaagctgaaattcaaatacagaaatctcttatttacggcttacatcgcaaccatcgcggttccgtggcaggtgtatatggttccccagttcatgatgatgagaaatttcggcctgaatgattcccatcttgccatcatctttctccaggcgttctctgcattcggggtgttcatgatgcgccagttctatcaggggatccctgatgaactgtgtgaggcggccaggatagacggcatgagtgaatatcagatttatggaaagatcatgctgccattgtcaaagccggcgctgtctactctcactatcttcacctttgtcaacacctggaacgattttttagggccattgatctacttaaaaacagaagcaaaaaagaccctgcagttagggcttaagatgttcatcagccagtacagttccgaatatggactgatcatggccgcgtccgtgctttccctgatcccggtccttatcgtattcttatccctgcagaaatatttcgtagaaggcattgcagcaacaggagtgaaaggataagaaaaaccggcctttttggtcatgaaagaatattacaaggaggtaaaaaagcgtgaacagacagacggaagctcttcttagagaaaaaccggagcttacagaagaaaagtgcagggaggccatggattttgctgcggagcaggtaaaggacaatttaaaggaatttacggagtcttttaagaaggcatacagtgaggatggattttacaatcccacccccaatgttaactggaccacaggcttctggacaggacagatatggctggcttacgagtggtgtaaggaggatgaactgaaaagggccggacagattcaggcaaaaagctttttggacaggatcgaccgcaaagtggaagtggatcatcatgatatgggatttctgtataccccttcctgtgtggcggcatataaactggtgggagatgaatcggcaaaggaggcagcgattaaagcggcagaccagctgctcagccgtttccagccggtgggagaatttatccaggcctgggggcctatgaaccaggtgtcaaactaccgctttatcattgactgccttttaaacctccccttattgtactgggccacagaagaaacaggggatccccaataccatgacatagcggaaaaacacattcatacggcaatcgcaaatgtcataagagaagattattccacctggcatacgtttttcatgaacatggagacaggagagccggatcatggggccacctgccagggatacagggatggctccgcctgggccagaggacaggcatggggagtctatggctgcgcccttgcttaccggtatacaaagcgtccggaatacattgaggatttcaagaatgtgaccggatactttttagaccaccttccctcagatctggtgccttactgggatctggaatttggtcagggctctgaggaaccgagagattcttcttctgcttccatagcagcctgcggaatgcttgaaatggcaaaatatttaaacgaaactgatgctgcctgctatatttccatagccaaaaagatcatggaatcggttgtggagcattacgcagtaaaagatttaagtgaatccaacggactggtgcttcacagcacctactccaagaaatctccttacaatacctgcacaccggaaggggtggatgaatgcaacatctggggagattatttctacatggaggctctcaccaggctgtctaaggattggaatccatattggtaataatcgaaataattcgaaaagaggcgaatatagatgaaacttgaaacaaagaaggatttccagcaatggatgtttaaggtattaaacccgttaaagccattgtacagccagggccgcgccaggctttctcttggggacaccggagtgacatatcaggcggtgagcatagagatggaagccttttcccggcctttgtgggccttagtgcccttgtggcttgggggaggaaggggatttgaggagatttaccagaagggccttgctaacggtacggatcctgcccatccggaatactggggcggttttaaggattatgatcagaagtttgtggaaatggcagccatagcaagcggcctgatttttaccccggaaaaattatgggagcctttatgtgaagaagaaaagaaaaatctggcaaaatggctttacgggatcaatgaatacatcattcctgactgcaactggcagtttttcatgatcctggtgaatattgcattaaaaaagctggactgccggtacagtgaagagcggctgtcctctggtcttgaaaaaatagaaagctattacgtgggagagggctggtaccgggatggggcttccagtcagaaggattattacatttcctttgccctgcattactacgggctgctgtacgcggtggcaatggaggatgaggaaccggaacggtgttttcggtttaaggagagggcaaagagatttgcaagggattttatatattggtttgatgaaaatgggtctgcccttccttacggaagaagcttgtcttaccgctttggagaagctgcattctggtcagcttatgtgtttgcaggacttaatgatattccagcaggggttgttaaggggattttatcgcgccatttaaactggtggctggagcagaagatttttgaccgtgacggagttttaaccattggatacggatatcccaacttaatcatgggagaacggtacaatgcgccaggttccccttactggggcatgaagacccttttgtgcctgggacttcccgatgaccatcccttctggaccgctaaggcccgggaactgccgaagctggataaagtaaaaatgctaaagcaggctgacatggtgatgcaccgtcatggaaaggatgtggtggcctatccggcaggagtgtgtgagaaatacggccatggccatgtgccggagaaatactccaagtttgcctattccacccgttttggattttccgttgcaaaaagtcagatcgtgcttcatgaaaacgccccggattcctccctggcttttgtcattgacggagatgattacgtgtttgtccggaaatacagcgattcctatgaggtttttcctgacaaggtcgtcagcaattggcatccctttccgggaatcacggtcacatccacaatcattcccaaggagtacggccatttgaggatccatgaaatccaaagccagtatgattgcactgcttatgactgcggtttctccgtgaaaaaattcacaagtggttatgaacagaaagcagcgggaaatgccgcttcaatatcccatacagatcagggctgcacagtatcagggaaaggcccggaggcagcaggccgggtgatcgaggctgatcctaataccaatgtgctttaccccaatgcttccatacctgctgtttcctaccggatcaataaaggagaaaccgttcggctggagacaaaggtggagagttttgtattctaagatgatccgttgattttaaaactctttggctgtataataggttcataaacaggaaccggcgaggagggcgacgaagatgtggataaataacaagcagaatttaaaggcttcttattataacagcttcttcgccctcatcgtcatccccattctttttattatcttactttccattctcatcatccgtaccatgatggtggattcctccgtttccaacatccggcgcgcccaggataacattgcatcagccctgggaggcgaagtgaaggatgtgtccctccgtttatcccatttcgtgtatgtcaatgacaatgaaattataaaaaatgcggccaaaaccaatacaaaggacgtggctgaaaaataccgctataccaagatcctcaccgaatcctttcactatgccatggttccggtgcaggacatcctgtctgccgtattctatatgaaagacggagaccatatctacatgaaggatgacattacccttggcatggaggaattgaaggcagcctcctggtatcaggaagccttggcagagcctaacgtggtaaaggtaggcttttatgaccgcagtgtgactaattccagaagaaatgcctataccctgaccattgccgcaggaatatctcccggaatggatgtggacagggatggagtcatagagatggcggcgctgtttacttcctcccgggcaggctggatgataaaggattataataaggagcgggtattgggatccaccatgattgcggacaagtcaggaaatgttatttttgacgcggaaggcaccatggcccttttgccccccggcatttccttagaacagccgaagttccggtacagggcagacggcaaacggtatatgggcgtggtgaccgaagagccggtgacaggccttaagatcatcagcgtggtggcatatgagacccttacaagaaaatttaaccagacagcagccgttattgtggctgttacgctcatcctgtttgcattgttttaccgtttttccagttatttcctgaaaagcatcattgaccccattcatcatacggtggagggcatgaagcgggtagaggaggggaatcttctggtccatgtggagccaaaagggcagccggagctgcgtctgatgatccattcctttaaccgcatgacaagacggctgaaacatctgatgcaggaaaatgaggagcagcagcaaaagaagcatgaggcggaaatcagggcgctccagtcccagatcaatcctcattttctggtgaactccttaaattccatccggtttattgcccagatgtcaaaatatgagtccattgcccgtatggcagaggcgctcattaagattttatcctgctccttccggagcaatggagaattttatcctttaaaagaggaactggaggttctggacggttatatctatctgatgaaaatccgttattccgatggttttgagataaattatgacatagagcagtcctgccagtcctgtcttgtcccccggcttattctccagcctgtggtggaaaattccattgttcacggtttcagcggcctgatggatgagatgggaaagatctggctgacggcttatgaaaaggaggggtttcttttcatcgagatccgggataatggaaaagggatgtctgaggaagagatacgccggatcatgagcggagaagagaagcgggaagggcaaaaggaccatgtgagcattggaatcaccaacgtgaaaaccagactggccctcaattatggcccaggctgtgaatttaagatggaaagcggggaaggccggttcacaaaaacctccatccgcatccccataagaagaaaggagccggaaaacatatgaggaatgtcctgatcgtggatgacgataccattatccggatcaccctgcgctctctggtcaactgggaagagatggggtatcatattgctgccgatgccatccacgggcagcaggccttggaatatataaaggatcatccggtagatttggtgatcacggatatgaaaatgccggtcatggatggaatcggtcttttggaagaattgaaccgtttgaaaaacatgcctgcagtgctggtattaagcggctatgacgattttaagctggttcgggatgcgttccgtctgggtgcccatgattatcttttaaaggccggattaacggaagagactcttgtatccatgctgaaacgcatggatgaggaggtctttcaaagccgcagcaaggaaacacaaggagagagggaaccggccgcaaaagtcccggattcggccctccttgcggacatggccgttggaaaacggtctcttgaggaatccttttttcaacatgaatatctggtgatgcagtttgaaatagaggattttcataaagcatcggcccgttttggtgaggattttgaagaagagctgataaagcccatgctggaactggccggtcagattccaagggtagcttcccgctgcattcttggggcagtggggccttcccgctattgtttgctgtaccgcataactgatccgggacagtataaggaaaattcggtttccgcctgcaggcagttatgcaatgtgtggaagcattttatgaacctctccgtgtccgcggggatcagcaggccgggaaagggggcggcggatttcctaaaccgttttgaagaggcaggagagcggttaaggcttaaatacttaaaaggaaaaggaaagatctgcgatccatgggaaaaggatatggtttcctttaaggaagtccggcagacagggcaggattatgaaaggcttttaaaagggctgatggtgggagatgagctggccgtatggtcggaaaagaaacggcttttttcagagctttacaaaatggaattaaaggctgccaaagagacctgcctttgcatcatctgcagtatggcctggcagctttcggataaccacgatgatatcggcgccctgtttgtggaagaggtcaattactatgaaaaaatcggacgtctggatgagatgagaagcctggaattatggctgaataatttttttcgctggatcatggattataatgcccaccaaacggaccggagacaggcggatatgatgatccgggcaaaacgattcatcatggacaattacgccaacccggaactgacccttggaagcgtggcgggctttgttggtcttaatgaaaaatacttcagcaccagatttacgaaggaagagggaatgaccttcagcaattatttaacagaggtccggatccgaaaagcaagggagctgatggagacaacggatttaaaaatttatgaaatcggccagagtgtgggctataacagcgtggagcattttaccagagtatttaaaaagctgtgcggagtcagcccgggagtgtaccggaaataaagatctgacaaaacatcaagttttcaaaccatatctcatggagaagcttgttttgaaatggtaatatagttatcagaaatcgcttttcagatttccgataaaaggcagtgcttttactgccgtccatctgactatgaaaacgtctttttgttttcataatataacgtcatcaaaacaagggaggtattacagcaatgagaaaacgagtgttggctttgggactttgtgcagcaatggctatgggaacaatggcaggctgctccccgtcaaagggaacaacggaaacccaaaaggaagaaactgcggcagcaggtcaggatggggcttccacggaagcaggaaaaacagaggcaaagaatgacttggaaggcagtctggtatttgcaatctgggacaataacctgatggattatattgatgaaaatgatatggttgggaaattccaggagaaatatcccaatgcggaaattgaagtagaaaagatcaaggatgattccgaatactggaatgccatgaagatgagaacttcggcaaaccagcttccggatgtcatgtttaacaaaccatttaccttatccagatttaaggattatctgctggatttatctgacttagaagcagcgaaaaacaacgagcttgcctccgggtatgcaatggatggcaaggtcctggggattcccatgacagcgggctatgaatacgtgtattactggaaagacatgtttaaggaagccggcgtagaagttcccaccacctgggaggactttgaaaaggctgctcagacccttcaggatcattacggaaaaaatgacccggatttcatggcaattgctcttggagcaaaggatgaatggccggattatccctatatggaatttatgccggcgcttcagggcggcaatggacagaactggaatgacatggcaaagtcagacgcaccttttgcagacggaacggatattaacaaagcgtacaataaggtatacagcttattcaccaaggatgtgttcggcaaagatccactcggcatgggcaatgaccaggtaactgctctgtttgcacagaaaaaggctgccatcattgcactgggagactggggcttacagaacattcagagcggtacggatgacgcttcagaactgggtaccttctatcttccggtaagagataccaaggatgatcctttccgtgtcattgtacagggcgattcctttatgggagtgaccacacacagcaagaatccggagctggcaaaggcatttgtggaatggttctacagtgaagactggtatcccggatacatcaactatgtgaccagtgcctcctctatgaagaacttccccaaggagaaggatcctattctggcccagtcggatgagcagcagccggataaggaactggttatgtatgacggcggcggagacagtttccaggcgatacagaacgaaatcgcatttgattataagaagcttggatcccagatgtttaccaatggctttgatcttaaggcggaactggatgggcttaatacaaaatgggcacaggccagaaccaagctgggaattaaataaacagaatggaaaagggggcagggtgatggaatcctgtccctttttcctccaaggacttatatcaggaggtttctatgaattcattagaaagacagaaaaaaaggtttattgtatgttcccttgtggtgcctatggcattgctcattgcatttgtggtgtttccggcccttgacttgatccgcatgagcttcacaaactgggatggatactccaggacctacgatgccattggttttggcaattacactgccatgttccgcaacaaggacttgtggctgtcccttcgaaacaacgcagtgtattttttcggacatctgatattcatacccattgagctgatgttcgctgttcttttgacttccaggcttcggggggcaaagttttataaaaccatggtttttatgccatatatcatcaacggagttgccatttcctatgctttctcttatttcttttctcccattaacggagcctttgatgagatattgaccgtatttcatctggaaagctttatcaggaactggctgtcagaccctaaaatcgtcaatttcgtccttacctttgtttccctgtggaggttctccgggtaccatgtcatccttttcatggcagccctccagtctcttcctcaggatgtgcaggaggcggccagagtggatggggccaatgcatggcagatgttccggtacattcagataccctccattatgctcatggtggattttgtccttttcgacaacatccgcggcgcccttcaggtatttgacattccttatgtcatgaccagcggaggaccggggtatgcttcctccacctttaccctttacaccattgatacggcctttaaatacagcaactttggccttgcttccaccatggccgtggcgattatgatcatgattgttgtcatttatctgatccagaacaagatcattcacggaatcattttaaaagggggggaaaaataagatgaaaacacgtacaatggaacaaggcttcaaacagatcttctgcatgggcatggtcctgatcgttctggcgcccattgctttgactttgtttgcggcttttaagacaaaggcggatatggtgaacacatcccccctgcttctcccgccaattgacagaatcacgtttttaaactttacaaaggtgctgggagataagtatctgttgatcggctttaagaatacgggcattatactggcggtcagcattctgtttaatgtgctgtttggcaccattaccgcgtttattctggaacgttttgagtttaagctgaaaaaggtgatcatgggcctgttcttcctgggcatgctgatccccagctttgtaacggaaattgccaggtttaagatcattaacagcatcgggctttacaatactcttggcgctcccattgtgatttatgtggcgtcagatttaatgcagctttacatttaccggcagttcatttcaacccttccggtatctcttgatgaaagtgctcttttagatggctgttcctatttcggcctgtttacaaagatcattttcccgctgctggcacctgccacggctacggtggtgatcatcaaagccattaccatcatcaatgacatgtacatcccatatctgtatatgccaaagaacaggctgcggaccttaactacctttctgatgaattacgccaatgcccagcagggatcctggcagaagctggcggccggcatcatcatcatcatgctgcccaccatcctgatctatatctttttccagaaatacattcttgcaggaatcgcagccggagcagtaaaggaataaaagatacatgaaatcgtaaaatatgcaatggattcttgaatcacagtcgcttataatggatctagagtatttatagaaggaggtttctttcaatggaacagaaaaccgcaaaactggaatggctggaggatccccgggtctttgcagtgaaccggctggccccgcattccgatcaccgctattacgagacggaagaggaagctataagggggagtatggggctgcgacagtccttaaacggaacgtggggattttcttacgcagaaaatcctgctgcaaggaaggcgcatttctacgaaagagattttagcctggacggctttggcaccatagaggttccgggacatatagagctccagggatacggcagatgccagtatattaataccatgtatccatgggatggtctggccgatatcaggccgcctcacacggacaaggagaataacccggttggaagctatatcagagaatttgagctggaggaaccactgaagggaaaacggctgttcttatcttttcagggagtggaaacggccttttatgtctggcttaacgggacctttatcggatattccgaggattcctttacgccctcggagtttgagattacagacgcccttcttccgggtaccaaccgccttggggtggaggtttataaaagaagcagtgcaagctggatcgaggatcaggatttcttccggttttccggtattttccgggaagtgtatttatatgctgttccggaatgccatataaatgatttattcatccacggagatgtgtctgatgattaccgggacggcttattccgggcggcgctgacccttaccggagaaacaaagggaaccatccatgccgtattaaaggatcgggcaggggaaacggccgcatcctgggaagccattcccgcagagaaagaagtggaattctcctgccgcattcccaatgcccgtttgtggagcggggaggacccttaccggtatgagcttacggtcaccttatacgatgaacatggaaatgtgaaagagatcgttccccaaaaggtgggcttccgccgttttgagctgaaggaccgtctgatgtgcttaaacggaaagagaattgtgtttcgggggatcaaccggcatgaattcaatgtgagaagaggccgctccatcacaaaagaggacatgctgtgggatatccggtttatgaaacgccacaacatcaacgcggtcagaacctgccattatccggatcaaagcttatggtatgagctttgcgatgaatacgggatctatctcattgatgaggcgaatttagaaagccatggttcctggcagaaaatgggagcctgcgagccttcctggaacgtgccaggaagtcttcctcagtggaaggactgtgtggtggaccgggcaaggtccatgttggagaggataagaaccatcccagcatcctgatctggtcctgcggcaatgaatcctatgcaggagaagacattctggcaatgtcggaattctttaaagaaagggatccttccaggctggtccactatgagggcgtattctggaaccgggaatttgaccggaccagtgatatggaaagccggatgtatgccaagccttctgaggtagaggaatatttaaagaaagatccggggaagccctttattctttgtgaatacatgcatgccatgggcaattcccttggagggatgaaaaagtacactgatttagaagaccggtatgagatgtaccagggcggttttatctgggattatattgaccagtccttaatgaaaaaggatgctttcggcaaggagcatatgacctatggcggagatttcggtgacagaccaaccgattacagcttttgcggaaacgggatcgtttatgctgacaggaccatttccccaaaggctcaggaggtcaaatacttatatcaggatatccgcctgattcctgactctaaaggcgtatccatagaaaacaggagattatttgcagatacctctgatctggagtttgtctattctgttttaaaggacggagaaccggtttatcagaagagcttccacacatcagtaaagcctttggaaacaggatatgaagttcttccaattccggatttcactgagccgggagaatatgtcctccaggtttcggctcttcttaaacatgatgccttgtgggcggaatccggctatgaaacagcctttggggaggcggtcacagtggtagaaggccggcaggaaaaatcctgtaaaaagcctttgacggtgattcacggcgatgtaaacatcggtgttatgggagatggcttccgggtattgttttccagacaggaaggcagcatggtttctatggtttatgatgggaaggaatggctgggaaggccgttgatgccggtatactggagggcgacgacggataatgacaaaggaaataagttttccgcagcaagctccgtgtggtatgggcaggcagattcccttattacagcaatgagaattgcaaggtggaagagaaagaaggaagtataaaggtgacctatacctatgagctatccactgttccccaagcggcagcagaggtttcctatgaagtagatggaagcggggccattaaggtaagagcattatttaaggggcaaaagggcttgcctcagcttccagcctttggcatgaggctcattacaccggaagcagctaaaaagtttacctggtatggaagaggcccggaggaaaattactgcgacaggaaggaaggagcaaggctgggtatctatgaggatacgcctgataacaacctttcccgttatctggtgccacaggagtgcggcaacaggaccggagtccgctggcttaagatagcggacatggaaggccattccctcaccttccgcgcatccggcctggcttttgatgcttccgtactttcctataccgcggaggaactggaatccgccacacacagagaggagcttcccctcccaagatatacggtagtgaacattttaggagcaatgagaggcgtaggcggcgatgacagctggggagcgccggttcatccggagtattgcataagcggggaaaaggagcttataacggaattcattatagaaggaagatcgtaaatgcaggcggcagatggcaggagtataaaaaatcctgctgtcagccgcgtttttgttctgccaaagagaatcaatgctattgataaaaataatcaggaaatctcaccccatttcccccagattgtactataataggattgaacaggcagaagtcagctggaaccgacagaaagcagctgaaagcagaatgtgcaggagcagatgcaaagccgaaaaccaggaagaaaagatagaggaggaaacaggatgtctactgcaattatttgcgtaattttaatcatcatttgctattttggattgagaagcaccataaaaaggacgaaaaatggctgctgtggaagcggcggcgatgaggtgaagaaaatcaaggcagctgataaagatatttcccattatccttatacccgcaccttagaggtagaaggaatgacctgcggaaactgtaaaatgagggttgagaatggattcaacagccgggaagggctgtatgcctctgtggatttaaagaaaaaactggctgtaatccatatgaaagagcaggttccggaggaagagctgaaggacatcgtgagaaaggccggatatacccctgggaatatagagtaagcgttctgtccattatgataaggcaaaaatgttaccggaatttgcagagaaaagaagatgattgcaaacagcagcgggcaatgatggtttgattggaaacccattattgtccgttgttttctgtttttcgggaaaaagagaattatctggaaaaatagattgtttttccctgttatacgtggtaagttgatagcagacaggaggtggcctgatgataaaagttacattttatgattctgcagaggatcatttgctggattttgcagtcattgtttcccggtacagggatcaatggatattttgcaaacacagggaccgaaacacctttgaatttccgggagggcaccgggaaaagggagaggatatcttaactgctgcaaagcgggaactttatgaagagacaggagccgcagaatatactttaaagcaggtctgcgcctattcggttcagaggcttgatgataaagaggcggatttaaaagagtcatttggcatgctcttttatagtgaggtaaaagaactgggagaaatgcctcctggctatgagatagaaatgatccggctgtttgatgaaatgccggattctcttacatatcctgagatccagccggaattaatggaaaagattctccgctctgttttctgatggccggaaggcaagaacgaatacactagaagtgtagtttttagaaaatgagaaaggtgaggaagatcatgatcattgattttaacgaaacagaagaaaccattctcccccattttaatggcggagaaaaagagtttaaggcaaaaatgcttgtggatgggaacaataagatcctctatggaaggctggagccaggagcaaccatagggctgcacactcatgatacaagcagcgaaatcatctatttcctgcagggaacggggaagatgctgatcgacggcggggaggaaaccgtacaggcaggattatgccattattgcccaaaagggcatactcacagtatgatcaataacagtgaggctgatttgattttctttgcggttgtcccccaacagtgacatactgctgtcatatttgggatgatataatttcaaagaaaagaagggggagttatgaagtttcaaggctctgcgccagcagtaacaaacacggaaaggcaggaagaaaggagatcacatgctggaatatataccgacccaagaggaaatgacttcactgttgggagaggctttatttgaatcatggaaaagcctttgtgaaagaattgaagaaaaatatgatatggagtgccaatggaacaggggaggcaaggcgtggaagtatgagtataaataccgcaggggcgggaaaactctctgcgctttgtatgcaagagaaaagtgctttggattcatggtgattctggggaaggcggaacgggaagcctttgaccaggaacgggagaactactcccctgaagttcaaagggtatacgatgaatcaacgacctatcacgacgggaaatggctgatgtttgaaataaaggatccatcgctgtttaatgatatgatggggcttttgaggataaagagaaggccgaataaaaagtagccggaatgattgggaggagatgtatgaaatatcattggatcgatgaatatttgaaatcaatgaagggagtatccagtgatttcaaggaggaatggaactggaccagatatcttcttggggataaaatgtttgccgcggtatgcaaggatgatcagggcagggatcagctgatcacatgtaagctggagccggcagaaggagattttttaaggcagaaatatgaagatatcataccaggctattatatgaacaaggttcattggaattccataaaagcagacgggaacgtgccggatgatttggtgaaggacttgctggagaaatcctattacctggttttgaccgggctgacgaaaaagaagcaaaaagaattgctgggagagtgaacctcatctgttgcaggattctccggcaggaagcataaggaatgtaggtgtgacccatgaaatattttggagaaggattaagcgatgttcataaggctttaagtaaaataatccgcaaggaagaagagaccgggcaggcaaaagctctctttttaaacctgcacagggaacttcacctttcagaaatatcagaaggggaagaaaatgaggtggacagacttcttggagatctgaaagcaaacgagtacgccatcatgccttccgaaaaggatgaaaccatagcatgggttttatggcatattgccaggatcgaggacctgaccatgggcattctggtgggaggcaggaaccagctttttgatgacggctggaaacaaaggatgaactcttccattacagataccggcaacgctctgtcagacgatgagatcatggatctaagcagaagaatcaatatttcagagctgctgcattaccggaacgaggttggaatcagaaccaggaacatagttaaaagtttaacatcaactgatatgagaacaaaggttccgttatcagggcttgataaaatccttttggaaggcggagtgacaaagcaggaggattctgtctggcttctggatttttggggcaaaaaggacaaagcagggattttgctgatgccgcctacccgccatgtcatgcttcatctcaatgactgctgtaagtggaaggagctcatcaggacaaagaagaggttttacaagagttcctgaggttttttgcagcaggaaagtgactggaaaataaagttaataaattgcttgacaaaataaagaattggcagtattctagtaattgtacgataaataccaataattctaagaaaaggaggcagaaacgatgaaacgttactattacacaatcggaatgaatagaatagcgaagttattttatatgaattcagtctgcctcagagaagatagaatctcatgatgatattgttatgggctaagtgacggcttttatcaaaagccgcttctatgagtatttaaccgcagtctgaatgaactgcggttatttttttgccatttaccggaaaaggccgccttatgctgcctttttcggtttttttacatatacgggtggttaacccattcatgcttgcaacaggtaaaggaggaaaagtatgaaaaatctatggaagtatggaaagaagtacagtttcttgtatgttttggcggttgtggccatggtcgtcagcattcttttggatgcagcggctccccagatcacaaagcatatcattgacgatgtcattgtgggaggacagatgcagattctcatgaggctgcttttagggcttgtgggaattggacttggaagagcggtgcttcagtacacaaaggagtatatttttgactatgcggcatcaggaatcggctgcagcttgagaaaggatttatttgaccacatccagaccctgtccatgggatactttgacagccacaacacgggggagctgatggccaggatcaaggatgatgcggaacgaatctggaacgccttcggatttgtaggaatgctggttttggaatgttccattcacacggcaattgtaatggtctgtatgtaccgtttaagccccatcctcaccctgattccgctggtgattctccctctcattgcctggtatgcggtcaaaatggaaaatggattgggagaggtttacgataagatcagcgagcagactgctgaactgaatacggtggcccaggagaatctggcaggtgtccggactgttaaggcctttgccagggaagattacgagatcgataaattcagaaagcacaacaaacagtattatgacttaaatatgaaacaggccagactgatcgtccgttaccagcctaacatctcctttttatcaaaggtgcttttaatggcggtcattgttgtgggcggcattttagtcattaacgataagatgaccattggagatctgggggcattttccgagtatgccaacaacattatctggcccatggaaatggtgggctggctcagcaatgatattgcagcagccgtggcctccaataagaagatcaaaaagatcatggaagagcagccggtcatctgcaatccggaaagtccggttctgccggaaaagatccagggagagcttgcgttcaaccatgtggactttgaactggatggaaaaagcattttaaaagatattgattttactttaacaaatgggaagacacttggtatcatgggtgtgaccggttccggtaaaagctccattgtcaatctgatcgagcgtttctatgacgtaacaaagggagaaattcttttggatggaatcaatgtaaaggatctgcctctatcccttctcagaggtcaggtatcggtggtcatgcaggatgtattcctgttttcagacagcataacggaaaacattaagacaggaaataaagatgcgacggaatgggaaagcgtacagcaggcctccattacggcaggcgcccatggctttatccagaagcttacagagcagtatgatacggtaatcggggagcggggagtcggactttccggaggacagaagcagaggatcagcattgccagagccattgcaaaacaaacgcctcttctgatcctggatgactctacctcggctcttgatatggagacggagaaggagatcgaggcccatcttacagagttaaaggacagttccaaaatcattatcgcccaccgcatttcagcagtgcgccgtgccgatgagatcctgatcctggatggaggacagatcgtggaacggggaacccatgaagagcttatggaaaagcgggggcaatattataaaacctatcaggtgcaatatggagaggaggagataaaatggcagtcaattcaagcagaatagatgaagatcagaaggaaattttcaaaaaggataccctgctccgcctgtaccggtatcttctggactttaaaaagcagatcgtcatcgttctttttatcatgtcaggaaccatagccatcagcatgtcggcaccccttatgatggaatatgccatcaatacctgcgtagcccagaaggatatgggcggcctgatccggctgggagcgggagcaacggtgctgttcctcttattccttgcaggaactaagatgcgaatgcgccttatggccgatgtgtccaaccgggtgcttttaaatatcagagaagagctttataaacacattcagaccctgggctttggtttttttgacagccggcctacgggaaaggtacttgcaagaatcatcggggatgtgaattccttaaaagatgttctgtcagacagcgtgacccagctgataccggacttacttacagtcctctgtgtggcggtcatcatgctgataaagaattaccgcctggcaatggcagcgctgctgactcttcccatattggcggtgggcatgttcctgatcgaaaccactgttcataaaaggtggcggatttaccgcaagaaaacatcaaatttaaacgcttatgttcatgaagatttatccggtatcaggatcatacagagttttgctgcggaaccggagacaaaagaggtatttcatgatctggtaaaccagcattacaaatccttcatggacgccgtcatcgtggcggatggcttcggccctctggtagaagttacatggggcctgggaggcttcctgctgtatttcatcggaatcaagattgttggagtggaaaaaatcggaatcggtacgtttcttgcattctccacctacatcgccatgttctggagccccatccggaatctggccaacttttataataagctgactaccaacatttctgctgcggaacgtatttttgatatcattgatacggaagcagagatcattgatcaggaaggagccgtgcccttaccggagcttaagggtgaggtggtctttgagcatgtatcctttgcttatggggatgagccggaccgcctgatcctggatgatgtgaatttttccgttaagcagggagaaaccattgccctggtaggccctacgggtgcggggaaaaccaccatcgtaaacctgatcagccgtttttacgaaacaacagggggaaaggttttaatcgacggtcatgagatcaaaaaggtgactttaaaaagcttaagaagccagatggggatcatgacccaggacaatttcctgttttccggaactattcgggataatatcaaatacggacgtctggaagcgtctgatgaagaggtgacggaggccgccaaagcagtcaacgcccatgaattcatcatgaagctggaaaacggatacgatacaatgatcagcgaaaggggggcaggactgtccatcggacagaggcagcttctggcttttgccaggaccatggtgtcaaagcctgggatcctgatccttgatgaagccacctccagcattgatacccataccgagctcctggtgcagaagggaatcgatgtccttttacagggcaggacttcttttgtcattgcccaccgcctttctaccatccgcaaggcagaccgcatttttgtcattgaccagggcaatatcatggaggcaggaaaccatgaagaactgatggaaatgaggggtgcgtactataaactataccagagccagttctcctagtttggaaaaaggattgaccggagggtcgaaatgcaataaaataggaggcgaggtgataaaatgacagaaggagcattggttttagaagggggttccctaagaggcgtatttacggccggagtgttggatgtgttcatggaacaagggatcgaaatgtcctatgtaaatggggtatcggccggttccatgtgcggcatgagctatgtgagcaagcagatcggccgtaccattaaagtggatttggattatgtcaatgataaacggtttttaagctttcggaatatggtaaaaaaccgctccatttttaattttgatttcctgttcggggaattatgcgataccctggttccctttgactatgatactttttggaaatcacagcagacctttgaggtggttgccacccgctgtaagacgggaaaaccggaatattttgaaaagagttcctgtgatgatttcgtcagcgcggtaaaggcttccagcagcattcccattttatccggcatggtttctgtaaaagggaaaaagtatctggatggaggctgttccatgcccattgcatatcagagggccattgatctgggatataaaaagatcgttgtagtcctcaccagagaacacgggtttcggaaatcccagctggacaaatggacaaaaagagggtatgagcgttatttcgctcctctgcctgagtttatgaaggctttgaaggaggttcctgaccggtataaccagatgcaggaagagatcgaccgcctggaagaggaaggaaagatctacgtcatccgtccggataagcacgtgacggtccaaagaacggaaaaggataagcggaagctggaggccctttacgaagacgggcgccgtttggcggaagaacatatggggaagctgaaggagtatctggagattgcagagtgaggaaatgtcatggaggcatagctttgtgcccggaagaatcgggccatagggcagaaatgcaaaaggcatacttttatgtcctgggaagaagggcagtaaagaggaaactccatacaggtatatctttatgccttggggaaaaggacaataaagaggaaactctttacaggcatacctttatgtcctggaaatagggcagtaaagaggttacaccttacaggtatccctttatgccctggaaaaaaaggcagtaaagaggaaaggaaagtacggtatagtttatgagtatttatgatacgttaaatccaatgcaaaaggaagcggtactccatacggagggaccgcttcttgtgctggcaggagccgggtctggcaagaccagggttcttacacaccgcattgcttatttaatagaagagaagaacatcaatccatggaacatcctggccatcacctttaccaataaggcggcaggagagatgagagagcgtgtagaccgtctggtgggctttggggcggacagcatctgggtctccacctttcattcatcctgtgtgcgcattctcaggcggcacatcgaaaatcttggctatacgacgaatttcaccatatatgattccgatgatcagaaaactctgatgcgccatgtattaaagggccttgatatggatccaaagatctataaagaccgtgccatgcttggacttatttccacggcaaagaacgagcttgtgacggcggaagaatttgaactgaatgcgggcggtgatttcaggcagaaaaaagcagctcagatatacaaagaataccagaaccagctaaagaagaataatgccctggactttgatgacctgatcatgaaaaccgtacagttatttcagaataaccaggaaatcctggattattatcaggaacgctttaaatacattatggtggatgagtaccaggataccaatacggcccagtttaagctcataagcctgctggcaggaaaatacagaaatctttgcgttgtgggggatgacgaccagtccatttataaattccgcggcgccaacattgaaaatatcttaaatttcgaaaaggcttatccgggagcaatcgtaattaagctggaacagaactaccggtccagccagagcattttaaatgcagccaacgaagtgatccgccataaccgggggaggaaagacaaaacactgtggactgccaatcaagaaggccctctggtgcagtttaagcagtttgaaaatgcttccgaagaggcagataccattgtccgggacattttaaacagctcctccgattaccaggactgtgctgttctttacaggacaaatgcccagtcccgtctgattgaagaaaaatgccttcaatacaatgttccataccgcatggtgggaggcgtgaatttctatcagaggagggagatcaaagatatcctgtcctatttaaagaccattgccaatggaagggatgacttatcctctttgaggatcatcaatgtgccaaagcgagggatcggagctaccagcctgggaagagtgcaggcctttgcatcggaacatggatttgccatttatgatgcattttgccgggcaaaggctgtgcccggacttgggaaagcggcggaaaagatccttaaatttacggagctgatcgaagatttccgggaaaggcttgaggaagagacctattccatccatgaactgattgaggacgttctggatgaaacaggctatcagaaggaactggaagcagaaggcgagatcgagtaccagacccgtctggaaaatatagaagaattgatcaataaagcggtcagctttgaaggagaacatgagcaccccaatctgagtgaatttctggaagaggtggctttggtggctgatgtggaccggatggatgattcggaaaacagggtgacccttatgaccctgcacagcgccaagggccttgagttcccaagggtgtatttaagcggaatggaagacggcttgttcccaagtatgatgtccatttcttctgatgataaggaggatgtggaagaggagcgccggctctgttatgtgggtattaccagagcccagaacttcctgatgatgacggcggcaaggcagcgtatggtcaatggagaaaccagatattccaagatcagccgtttcattgatgagatccctgatgatcttttggattctaataaactggagtcaaggctgtcttcttccaggaccgctgattatgatgacagcggactgccatggggaaaagcaaggtcaaccggcagaacggcaggtgtcagcagctttggaccggggaacaacgcatatgcatcaaaaactgcagcgccagcgtcaacacctggctttggcaaagcctttaccgttgaaaaagcgtcttctttaaattataaagagggggaccgggtcagccatgtaaagttcggggaaggccaggtactggagatcaaggatggcggaagagattttgaagtcaccgtccggtttgaccaggccggcgtcaagaaaatgtttgcttcctttgcaaagctgaaattagtgtgagtttaatttgaaaatacataatttattaaaaaaaagcaaaaatgatagtaaaagaatcaatataatggtataataactgcgacaggcagagagactaaaacttagccggaagatatgaaaaaatgctttgcaggcatacctttatgcctgaagggctggcagaaaaaaagcagggctctcagaaaggacgtggagacatgaacagatttgatgcaatgagtaaagaagccatgagcaggctggaagattttatgaactcaagcaagatgaatgaattgcttcataaaagggaacaggaagagaagaagaaaaactgtatcctctggatactggctatcataggtgcagtggctgcggtagcagggattgcttataccgtataccgtttcttcacaccggactatttagaagatttcgaagacgattttgatgatgatttcgacgatgatttctttgaagatgataaaccgggcgaaggttctgaagagtaggatcggcattataaaagggagagcgtgcctcagacagtgagacacgcttttttgctcggttgggagacatgaaatacttatggcaggttatggggggggttgccccctgcggcagccgttggatacaggaatgttggcattcctgtgtctggccattgtttgcagaaataaagttagaagaggagcacgtaaagtgaaaaagggtgagatatacgaagggaccatcggaagatttgactttccggacaaagggatcatggagcttccggaagggaaaattacggtaaagcattcacttcccggccaaaaggtgcgggttatgataaataaaaaaagaggagggcgctgtgaggggcggattcttgaggtattggagcattcaagcctggaatcggcagcagatccctgccctcattttggaagctgcgggggctgtgtttatcagaccattccgtatgaggaacagcttaagatcaaggagcagcaggtaaaggcccttatagacggtgtctgtgagaattatgaatttgaagggatacgtccaagccctgtggaagctgaatataggaacaagatggaattctcttttggtgatgaatataaggatggccccctggccctgggaatgcataagagggggagcttttatgatgtggtgaccactacggaatgcaggattgttaatccggatttctgcagtatcttaaaggtggcaaaggaatattttgaaaacctggggatcgggttttataagaagatgcagcacacgggttatctgcgccatcttttggtgcgcagggccgtgaaaaccggtgaaattttggtggcattggttaccacgacccaggaagaggtggatttaaagccttttacggaaatgctgctggatcttccgttaaatggaaaaatcgttgggattcttcatattttaaatgacagcctggcggatgtggttaagagtgacaggaccgatatcttatatggacaggattatttttatgaggagcttttagggctgaaattcaaaatttctccgttttccttttttcagaccaattcccttggggcagaagtcctgtatgagacagtgagagggtatgtgggagatacgaaagataaggtggtatttgatttatacagcggaaccggtacgattgcccagatcattgctcctgttgctaaaaaagtggtgggcgtagagattgtgaaagaggctgtggaagcagcaagagagaatacgaagctgaatggacttgaaaattgtgaatttattgacggggatgttcttaaggttattgatgaattaaaggataagccggatttgattattttggatcctccgagggatgggattcatccaaaggcgttggggaagatcattgattttggtgtggacaggctggtgtatgtttcttgtaagccgacaagtttggtaagggatttggtagttcttcaggagagagggtatcgggtggagaaggtttgttgtgtggatatgtttccttctacggctaatacagaagttgtagtcctgttgcaacgttaaaaatattgatgattggaaatgagcagtaccccttgagcgtgagagcgattttgcttttgcgctctttttcttagagtaactaaaaaaatttaataaggagaatacttttatgaaaaagattacgtttatcccggctataaactctttgaaaaataccggaaaattaaaggttgcggcatattgcagagtcagtaccgagcgcgaaacccagaaaagtagcattgatctacagatcaattattatactgacctgattcaggcaaatcctgaatgggattttgcgggcgtattttatgattatgaaagcgggcttagaaaagagaaacggaatggtttggatgcgattcttaagaaggcataccgtggtgaaattgactatatcattaccaagtctatcagcagattgtccagaaatatattagatatgctaactattagccggagtttaaaagcaaaaggtataaatatctattttgaaaaggaaaatttaaattcacttgaatcagaaaaagaaatagatattacagtcaatgggattttagcacaggaggagagcaggaatttaagcgaaaatgttcaatggggatacaaacgtaaatttgaaagaggggatgattttgtcggcaagatacccatgggatacaagcgtgacaatgatgaatggatagttgtgccggaagaagctgatatcataaggagaatttaccagttgtatttggaaggcagcacactgcaacagataaaagagtatctggaagatcatcagattaaaaccgctacagggaaagacgcatgggcaacagcagttattcaaaagatactgaagaatgagaaatataagggcgattccttacttcaaaagacctatacagaagattttataacaagcagaaaaagcaagaatgttgggcaaagagaacgttactatataacgaatagtcatccggctattattactgccgaagtatttgataaggttcaggaagaaatgtctagacgcgcaaggctagttcgtaaagacgatggcacagtggaatctagcactagcaaatatagtggcaaatatcttttgggaaatcttcttgtgtgtggagactgtggtgcttcatatcggagaagaaaagaaaggggaaaggtggtttggagatgtgcaacgagaatcgaaaagggcaaagatatctgtccccattcccccactctagatgaaagatgggttaaaaatgtcttagtcgaaaagatttgtgagaacggagtatataacgaagaagtcgtcaaaaatgaagttgattgtattttcgtgtttagtagagatttgcaaatccacggcaaagatgaaagcatatttagcgttaagctcttacagagcaaaatgtgattttcttttcttcgttgacgccttgcatcaaattcaaatttgcgatgaaaaataataagcagacttggataaaatgttttctactgaaaaatggttaatattaaaatcttctgaatgttactgtcagaagttcccttgacgctatattggaacaccgatataatggctatgggtgatgaaaatgacaataaaatatggacgctggaaagacaaacagaaaaacttatttggaaactggattgccagagagcattcaaaaggcaataaaggaatacgtacaaggcgaaaagggacaggtgctctatctcgattgcttgtggggagaattatatggagctattaattctaacctttgggctggcttgatgacagaggaacaggcagactatctgcatgtaaaatatcttggtacagagggaaaggagaacaactttcctaattgattttacatcgtatgagataaataaattcagcatctacgacgaggcaaacgggaataaaactaatattctttataatggaaataatgatatgtttaaatttccacctgctacaagccataataaaaccatgatttataccaatgggtgtatcagtgaatagcctgttggagtgaaaagattgataaatcaaaggcattcaagattgtaaaagaggaaagaatgtgagttttttgccttgataagtactggagaaagattgttttctccgtgaggtaaatctatatgtttaaaattgaatttaagattacggctataatgcgtaattattaagttgcttttaaagagtgtaaatatggatagagtaattaaaagtggactatttagtttctatttgaggtcattaagatgaagagtacgaaaggagtgcgtgaaaagtgagacaatcagttatcctgccaagtacacatgatcatatttttctttatgaagcacaagactcgggtttagtaaagagaattccttcgtatgcggatgaattatatgattccaatgagttaaaaatggcagaggaagactataaaaatcatttgagaagtatacctggtttaaaacaagaactgtttcaatcaattttactttttgatgaaataattttggataaagcggatatgaattataattacaaagatttagaagaaacaggactttttagagtcattgatttcgagaaatcttattactataatcccatgcaagaggaaggtcatattgaatatgctggttatttagaacctgccatcattcctgttcttttaaaaagattaaatcgatattttcctttgattcctaagggaattaatttcacaaagtttgttactgcgttttacgaaatggttttgatgaagaaaaaattaacaaaggaataccataatttaatagagataaacaaaaaagagtttgataagaaatacaaatttgataaatggtatggaagactaaaatcatttcaagctccctcaattatgttggaaggtagatactattatgatatacaaagtcatgtaataactctttatgattctttgtgctggcaattaatgataagttctgattatgaatctgcaattatgaatagtgagtttgaactggtaaaaataggctgtgagtcatttactggtaatattgatttatctttacaagcatatagaatattacaagttgaatgttcaaaattaattggtactttaccagaagtaaacactatgagagacatgcttaagttaaaagaaacgagaaaaaacgatattaacaacttaagacgggaattgtcttatctagaacaaatccttcgagatggaggaactgaaaaaacaatagagcgaattgcaaaagatataaaaaaagcttccaaggcattgtctacaggtaacaatataagagaggtaggtaaatgggtaaatcgatttctaattcctgccgatttatgtacaggattacttagtatatcttctgaatcaataattcctaaaatagctttgggtggattgttgatggcaacagcgataggacagaccgctccagaaataagcgaatttatagaaagtaaacataaatggttcgaggtagtaactaaatagttaaaaatgggttgatacatatctttttactattgatataatacacaggtgcgtcgtttccctggaatgaggcagcaaagagtaagataatgcgaagtaatcagcaggggatattttcgctcctactgaaaatggttaaggctaagatttccagtgggctggggatcttagcttaaagtatcacatttatatattgcacaagtcaagagaaaacatggtataattgaaagggttaattataatgttggtgatgggaaagcaaacgtgccacaagtatcgccagaaaaagaaaaggctattgaggatgcgttaagatattttcaaatgatataaaaaatctgaacatggcttataatattatgaatggaggcaatgtattaacatggatgccatattaaaaaaagacgctcaatatcaattaggactttatttattacaatttgaaacattatgtcattttaatttgataaaatgtttagttgaaattttcaaaatagatacattgcagcctaaatacggttgtgaagcaggactaaacacttttatagcaataggttatcaacttgatgcgtctgttatcttatatgaaagtataaagcatttttgtatattttctgagaaagaaagtaaagcgtttacagaacagccatgttatcccgatttagaggtagtgcgaaataatattcatacatattttaaagatggtggatttgctgaaaaagcaaatactattataaaagataaactaaaagaatacaaacttgaaaaaccggacatgttttccgcattaagaaatgatatttctttggtgttccatattaaaaataactcaagacgtcttatcggctgtgattactttatttatcactgtatttatgaaagtgaaaataaaaaatgggagggaacagactatcgtgattattctgaatttctgtcatctaatattaaagctattgcttcaacagtagatgaaataccatatcagttatctcaattgcgctttcgtgagcaaatgcctacagttgaattatttgattataaaagtgctgatttgatgaattgcagtgtggtttcccctgcatctacttttagattaatgctaatcttgtatcaaattagctatgcattgcttttaacagatgaaatattcgattataaaattattgataaagatgatatgtggtcttgcttttttattaagattgtagctattaaatatgatgaatcttttgataactttcaaagcttattaaaattttccccaaaagaagatattaaaattttgaataaatattttgaaaacgaaaaactcaatctcgagaatttaggagccagaggatttgctcaaaaacttagaaacacattacactatcaagaaatattgttagacaccaataaaatgacaggaaattctactaaagacattgttacagcaatttacttgtctaacactgaaacaaattctatgacggaatttagaaataagggcttgaaaatgataaatgaaatgagatcattacaaagaattattcgtaagataatttcggtagacaagaattacattgaatagaaagtgcagcgatttagtttgagaaaatattcaccgttttcaagatttcctaaagactgttgtggtcttacatgtgacttattaggacagtatttgtctgaaaatggtatataaacatatctaatgaacggtgtatgcaaatgcgattcattatggcatcatgtatggttattgactattgatgcgattgtaatagacattactggagaccaatttgtggataaattggtttcttcaatagagattaaagcggtacatgtcggaatagaaggagtcatacatagattatttaacttgagaagacaacctgagaaaaatactgtttttattgacactaatgattttactggttttgggggcatccaagtccacgccaacaaatattaatggaagtatacgaaataatatgtcgatatttataatttaaaattgaacaaaatcgctgaaccataaccttagcaggttatcgcaacgctgattttgttcaattccagtttatctctatataggaatagaaaaatacaattgttttgaaggataggcttgaggggaattgaacccctcggtgtccaaacattacttgtctttgttcctcatttaatagttctatgcaaagcctacacgcacctgcacctaccaaaatgtttttaaatagttcaattattgacataagcgtacttcctgaaaagataaatctaaaggtaaagtttcttttggggctggtagcatagaggacggaacaacaagaaaatataataccaagtgatgcattaactggcaattttactatcagaattattatatacctaattagcgagaaaatcaatattggagaatatagactcatattattcatattataataattaagggaactatttttatatgaattagagaaagacaaattccgatttgtgaagagaaatgatagtggatccaaagatagtattttctaccgaaaactactaagggctttattattagcagtctttatctttattaaaatatacatcaataaataggagtcgccatgttctaattagcatagaatatttgtgaaaaggaaaggctgagcgtcagaattattgaaaatataacttgacgtcaagggaggagtgggttcgatggtcatcagaattacagcaacaaggaatacagaatgttgcgttctgttgcaacgggaggcaaattagaaaaatgaatatttgatacacaaacagcgtgaaggttattcaaaccttcacgctgtttgtgtatcaaggaaaggaaaacatagtaagcgccaagtattagggtggctggcacttcgccaccaaatgctccataatgatagatagctagatgcaagtactttactctggaatgcagcgcattccgttgataggtgcgggcatttcactacatattcatggaggtaattaaaatgtccagttatcatgccagagttccggcagatcagcaataccagttgatcatggaatgtcggaatagtggactctccgactatcagtggtgtaaggaacacggaattcatccgggaaccttttacaactgggttagtctgctcagaaagaaagcttgctgcgaaatcccagaatccatttccaaagagaatccgtcgccagctcttgttcaggaagtggttcgcttaaaccttcattcaaaagctgagatgcaggaatcggttgttttggtcccaccagttttagcggattccaccagatcatccgggattgctgccatgatagaaatatcacttggacatgctactatccggattgccaatggcacagagcccgccatgctggatcgtatcctgagtcttgtaaaaggtgcggtatgctaggcaatatttcggtggctgacaacatctatatcatctgtggaactaccgatatgcgtaaatcaattgatggtctctgcagtatcgtacgtgacaaactttccatcgacccggatcagtcatccttgttccttttctgcggaaagcgctgtgatcggattaaggtactgctccatgaaccagatgggtatgtgctcctttacaagcgcttgagtgtcacacagggacgataccgttggccacgaaagagttcagaagcacaggcgattacctggcggcagcttgactggctcctcagtggtctggagattgaacagcccaaggctatccagaccggataaaaaaatctattgtgaaatcgccgaaatttttcggctgtatttcaccaacaaacgtggataactgttccgtgttttctcctgatagggataacttttgcaaggctccagctataacggattctatggctatatgagacatttatggcagtaaatatgttttgttatccagtctttttgattctgccaacgaattatccaccgtcattatgacaaagtgcggctctgtctgaattcgcttttttctctgttttctggtaaaataccagtaacgaaacaaaggagcgaaaaaccatggcatccagcgtaaaggatatccagttcaaggaactgaaggatacgatctcacaactgaatacaaccatacgtacccagaatgatctaatcacatccctacagaagatgcttgaggaacgtaacgcaaaggatgatgaaaaggatcgggtcattgcaaatctgcaggcacagcttgaatatttcaagcagaagctttttggcagttccagtgagcggcgcagtgacatgccaggtcatctggatcttttcgccgatcctgattccgaagaggaacctttgccggaacttatcgaaccggagttcatcgatgggaaggcaggcaaacgggaacgtaaacccaaagcgagctacgatgagatgttcgcaaatctgccaatccactatgaagaagtgtatacactgacagaagaagaaaaacaatgcccggtctgtgggatcatgatggtaccaattggtcatgaagagatacgaaccgaaatacgctataccaaagcaaagctggaacgcatcgtatacgttgcaaccacctacggctgctcagtctgtaaagatacggaaaatcctcagttcatcaaggatgaagggatcccggctctgatcccgggtggatacgcctcatcatccctcgtatcacacatcatgtacgagaagtatgcagatgcccttcctctatatcggcaggaaaaaggctttgaacttcttggcgtcagtatcagcagaacgaccatggcgagttggatcatcatctgttcccagaattatctgaaaccagtgtatgactactttcaccgcgaactgctgaaacggcatttcgtgatggcggatgagacaccaatccaggtattaaaggaaccagaccgcagaccacagagcaagtcctatgtctggctgatgcgttccggagaagaccggctaccgcacatcgttgtgtatcactattcagagacacgggccggagaacatgccgtcagtttcctgagagggatcgaggatggtacttacgtcatggttgatggttacagtggctataacaaactgaagaatatcaggaggtgctgctgttacgctcacatccgaagatatctgattgaagccattccaaacggccatgataaggactatagccatccggcggttcagggcgttgtgtactgtaacaagctgtttgagtatgaacgcagctacaaggcaaaggaattgccttatacgcaggtttacaaacgccgccagaaggaccagaagccggtcgtggaaggtttcatgcgctggctcgatgcgcagcatcccgaaaagggaagccgcatggatcgggcagtgacttatatccgaaatcgaaaagacaccttaatgacttatcttgaagacggacgctgcagcctgagtaacaacccatcggagaattcaatccgaccactgaccttaggccgcaagaactggctattcagtgacagccaggatggtgcgaatgcgagcatggtagtttataccatggtagagatggccaaagcccatgggctccacccgtacaactacctgcaatacttgctcgacagtcgccctggcaaagatactaccgatacagaattcgaagttctcgcaccgtggagcgaaaaggctaggatagaatgcaacaagaaatcagagtaaaacgctcgcaaccctgacatcacatgttggtgccggggttagcgtgttgggataccctaacacttggcgcttacaaaacatatgaagaaagttataaaattaccagtaagagatttggagagcagtgtaaatcaaaagaaacgggttgcggcctactgccgtatcagcacgaaatttgaagaacagcacaaaagtttagaaatgcaaatgagttactataaaaatatgattttgaataattcagagtgggaattcgcaggcttttttttcgactgcgagagtggtctgagaaaatcaaagcgtagtggattaaataatttgatggccatcgtatgagctggacatatcgattgcatattgacgaagtctatcagtcgggtttcgagaaacgtgttggacacattgctgattgtcagagaattaaaagaaagaggcgttgatatatattttgaaaaagagaatctccattccattgacagtgcaaaagagatagacattgctttgggggcagtattggaacaggaagaaagccataatttaagcggaaatgtacattggggtatagcagaaaatgtgaaacagaagcaaatatcacgctaatcaagccagtgtatggttttagatgtgaaaataatgaactaattattgttccacaggaagcatctattgttaaagaaattttccgtctatatctggagggtaaaacagttcgacaaatcaaaatctctttagaggagaaagaagtgctatcgtccagtggaaaaacaacttgggcagatactacaattcagcagattttaaaatgtgaaaatataaaggagatgttatgtttcaaaaaacttatattgaagattatctgaccggaaagaggaaagttaattgtgggcagcgccagaggtgttatgttacgggtaatcataaaggaattatattccctgaagtttttcatcaggttcaggatgagatgtttagcagggggcacgggtggttttaaatgaagatggagaacaaattagcactgggaatagatatagtagtaaatatttattcggtaatcttttgaagtgtggaaactgtggtgcaagttattatcgtcgaaccgaacgcggaaaaatcgtatggagatgtgggacaagaatggagaaagggaaagaagtttgtggacattcacctactttacaagatgatgaaattaagagttttttgggtgaaacagtgtgcggaaattcctacaatgaagcaattattaaagataaggtgaagagaatagatgtatatgaaaagcaaattatcatttgcgtatctggcacagaacaatattttatttgtgagcaatagatttgagatatctgaacagagatagccgttagagaatgcaagtgtaactccaagtatgtatgaaaaaagatttttaattggggagaaaattcctttattataatataaaccaatttcttttatcctcgaatatatttaaatcatgagtatgaatgtagtcacttcaatttatggaatcgaggtgaagcaggaaatattgatatatgttatttgaatttataagtaaattacatatgtcagtcagaatataaatgaattttctgactgacatatgtattgttgaattattatgttgagatataatgattttgcatatataatcaaatatatagaaacaactggaagaaagattttctgagataaaaatcgataaagaaagaaaagttggacgaaatgaaaactaaaactacaaagagtgaaaacgggcaaatgtaaaatatatataatgctttaaaaatatctatagataagggggagaataatatgtatttaaaaaaaattattataaaaaactttagaacttttgatgaagacggtatatcactaatctttaataaaggtgtgaatgcaattattggtgaaaataattctggaaaatcttctgtaatagatgtgcttagaattgtttattcaactgtaacatacagaaaggatatatttttttcaaagtcggattttcatgttagtgaagatgggggagtggccaattacgcccaatttgatgtatatttggaggaggtcccgcgcaggttggtagaaatttggaatccgaggagtgagagtggtgagggaggcgattttcatattaaatttgaaaaatatgtttctccaaatggaaccgaaaaggttagatcagtttattggggatttggaacagagggaaatcaattatctgccgatacgtttgaagcaacagatgtagtttttttaggtgcattgcgggattcagaaagcgagatgaaaccttcaagaaatagtaaattggcacaattacttagaaatttggttccgggagaagaggtcagggcagaattagttcaaattttgaatgatgctaataatagtcttctagaaaaagagcagttaaaaaagacacgaaatacaataaatcaaaatcttgcaagaattgaacaggagtttttaaatcaacaaattgacattggtttggtagagccgagatttgattcaattgccgcttccttgcgggcgtgggttaagcctaagtggatattgataaataaattagatccagtttatgaaaaagcatatatctatcatcaaaatcacaaaaaatcaaagaaaatacaagctgatgaaaaaggcatatacttcgaaatttctattttggctgatgaaactggatttgacaaggaaatggccaacagaattggtgacattgcgaatagctcttttgagctatatcagaatggattagggtataataatttattgtttatgtcagctgtacttggcgatatggcaattgagaaaggtggggtttatcagaatcttctgctagtggaggaaccagaagctcatttacatcctcagctgcaggaattggtgcatagttttctggcagatgccaataaaagtgatggtaatatccagattatatacacatcgcattctccgacattagcttctaaagttgatatagcaagcatcaacctggtatatgaatatggacataagaaatattgtttgcctttttcggaaacgaatttgacagaagaaaataaaggatatttgcagaggtatctggatgtcacaaaatctcagatgttttttgcacgaggaattttatttgtggaagggattagtgaagcagttttgctacctacaatggcaaaggcattagacagaccttttgaaaagtatgcagtggaattagtcaatgtagatagtgttgcatttgcaccatttgtaaatcttttgtcatctgatagagtaaagacttgtttttcaaaggtgtcgattattacagatgatgacagatgtgcaaaaaaagatgaggaagaatacattgataaaaattatgatttcgatgatatttgcaatatggttgttacaaaattacaaaatggacatccctcagataggtgtaataatttaatggtattatgttccagtgcaggaattaatatatttacagcaaccaaaacattagaatatgcattgtgctgtagtgaagataatgtttactatatgataaatgcattgaagaaatgttatacagatttggggactaagttagaagcaaaggttgcagccttatctcaattaagtgaaaaagcagcgtgtgtgtggctgtttattagaaccagagataaatgtaaaggagctgttgcacaatacataagccaggttatcagtaatcagtatgaattaagaaaaaaaggagaacgaattgaaaaggagttcactatcccagattatttaaaacatgcgatttatagtgtgacggaacaatagtatggtagagaaaatgacggaagaacaaaaaaagtttttagctgcagaaggtaaagtggttgtaaaggcttgcccgggaagtggaaaaacgtatacagttgcacacaaattattatcttatgtagataattggaaagattatcacagaggtgttgcagtgttatcgtttacgaatgtggcaagtaatgaaatatatataaaggctcaaacaattcatgggagtttaggtaaactgggataccctcattttgttgggacagttgatagttttattgatgaatttattgtgttacgttatgggcatcttcatacggttggtaaggtgcgcccgaggatggcactggctgataattggaaaataccatataaatattggaggtcagaatgtcatagaaatggctgcgtagacagtgtagaacaattttattatggaattgatgggaacttttataaaggaaataagcaggtgacctgtgaccgtaaaaatgcaagggcacttccgtgtcaacaatataagaggatgttgtcagaacgagatattgtttttcaaaatgagacagctttatttgcatatcagttattaaagaaatatccagaagtggcgaatgctataacggaaagatttccgataattattattgatgaagtccaagatacatcgataaaccaaatggcagtttttgaattgttaagtgactcagggttggaatcaatgtttttagtgggagactcggatcagtcgatatatgaatggagaaatgcagacccagagtgttttatccggaaattagaggatccaaattggaaaactatagaactgaccggaaactttagaagctcacagaatatctgtaatgctacttcacctttttctgctagtttgaggggtactagtaataataatgcaataggggattggaaagatgagaaggaaaaaccagttttattactgacaaagaaaaattcagaggatgatattatccattattttttggataagtgtagaaagatgggaatagaggaatcgccggagaatgttgcaatcttaactagagggagaatatattctgatacagatataacaggattatggaaaagcaaagaaatagagttgtttgctaaagcagcatatgaatggaaacgtggttcgagaaagcgagcataccaagaagcatcaaaggcatcctatgatttgatttttaatgaagatgtagatgaatatgtgatgaagcaaaaaatctgggagtacaccaacgaagaaacatggaaagattatgtcatagatattttggtagatatgcctgatattgaaatgggaattgcggaatgggtaaaaagcttttcggttatcttttgctcaatatgcactaaatacggttatgaaatttcaccacataaagatatcaagaatatttttaagataaaacagagtgacaaaaatgtaccgtattttaagcaaatatcgttaagtaaatattttgaaaagaagatagaagataaatatacccgatcgtcaattcatggagtaaaaggagaatcttatgatgcagtgctaatttatatcaaaagccgtacaggaagtacaattacccctaaactactgatggagggctctcttgatcaggaactgatgcgtttggcatacgttgctatgactagaccaagaagattactaatgattgctatgccagatactaaaggaataaaaaattgtggaagatttccagaagaattgtggaaatatgagtttttggaaagcggttcatgaaaaatattttgttatatgatgatggtggtgtgatagtaggtgctattatatttggtagcggtcacttgaatttacgcaagattggtcgaactagaagatatcaatgtatgttgaggtaaataatgagcaaattagataaattaagtgtatttatatctcttgtattaaggcataaaccagatgctgcgaatattaagttagacgagtttgaatggatgaatactaaattacttgatggaatgaatgatacaggcagaaaaatcaatatggaggtattagaagaaattgttgcaacggataataagcagcgttatagttttaatgcagataagacgctaatcagggcaaaccaggggcatagtattccggttgatgtagaattgatagagcaagaaccacctgaagttttgtaccatggaacagcaggaagattcttatcaagtatattatctgatggactaaaaccgatgagtcgattatatgtacatctatcagatgatatggaaacagcgattagagttggtaagcggcatgataatcctattgttttaaaagtacatagtggcgaaatgtataagatagattgaagttctatttatcaatcaatggtgtatggctaacaaaatgtgtagagaacaagtattttgaattggaagactgattttaaaagagaataaaggcatgaatgaaagttgactttttaattatattttagcttattaggatttcatgtaaactatgaaattataatggacgaaacagaaagcgttttatctaaaatagaagctactttatgatgctgacgcatcttggaaatccaccgcccaaatggaagaattatctcatcgtgatcgaagtatgattggaaaatatatcagaaatatttttagaagaagtgaatcagagaaaaaatcagtgtgggcaaaatctacccacgctgtctctgataaaaacaacgtgtaaagtgttcaaattgcaaataactaattaatggatttaatcaagttatacattgcaaagaagtatttcaagataggagaagatggaaacttacatttaggaatggggctatctttcatttaaaataaaaatagcagatctgaggtagaagttctctaaaatttcgataataaaaaatgaaaagcaatacccaagaagttcgtttctataaaaaaactgctaagactaaaagtaccagtacgctgagtctttattgttaacagcttttacttttactagattcggcatcgaaaaatgagagttgccatgttataattggtatagttattttatagaaaacaagagtcaagtgttcgtaattgttaaaggtacaccctgacaccgaggagatattaaagatgataaagttgggttaaattataggaaattttacatagataatattaagaacaaataaagaaatcggataacgccgttcatttcattatgaaatttatatgtttacttgaaaaagacctgaaagtggtaaaattatatacaatgtagaattaaaagtctatagattatcaaaagtgattatgattaatgcagtacatttatttaatacataaaatgatgatagaggaaacaaatgagtgaaaataagaatattcaagatggttattgggctatagcagcagaaaaacatttaaaaaattatattgaagaaagtcaaaatttagatgaagtggacaatttaaacattgcaggaaaatcgggtcgttttctcggcacaattaggggtaatggaacaattgaaaatatcaaaaaaattgaaaaaatggctggaagtgttggaattagaaaaagtactttacataaaataattttacctgagattgaaagagcatctgataaaattgaaattattagaaatacaattggagaaatcacaggcatcgcagaatatttgtttgattcaaaaaatgttttgggaattgctggagaagtctttgagaaccaaaaccccaatataatagaaaaaattgctattgaaactatggaagctacgaaaaagttgccatattatcaaggagaaattattgataaattaataaaaaatggatataaggaacaggatattcaattatcaattgcaatacaggagcaatttcaattgattcaaaaagtaaatttaactaaaacgaaagatcctattattagtaatgaatatatctggggagaaaaccacaaaaaaattgcagcagctatagcaccgcttgattttggaaagaagcaaacattaaaggatgttatagaaatagttcaaaataagcaaggaattccacttgaacaactgccaaatgtagacgcagaacttcttcaattagccaagaaggtgggaatattaaatccaacaattatatcgtcatcaagggggttcaataaagagttcgaattttctactaatctattacatgaagattcacaagacaaagatattttagacgacgttaaattattattagcatctattagatttggagaaaattatacagaatattcaactattaatgattcggctaaatttttacgggcattaataaatagaggaacagtaggtccgcattcatcaaatggaactgattatttgcttttggaaaagagaggtattgttaaagtagaaaaaagaagtaaatataattattatacacgtcaaactcgcgaggggtattgtttaaaattattaaaacaagatatagcggaagaagcactaagaattattgaatcaaaagaatatagtataaaactaacagaaagtataagtgattgtaatataatttccgaatgtggttcatttgattcaccagaagaaactagagttaaaatgggattattgccagaaccagtaagagcagcacaagagcatttaaataaggttttaagagatgaattaatataggaggatgaaatggacggaacgaataaagaaataaaatatgaacaattaatattagataatactactgatattaataataatgggacaaaacaaaaaaagagtattagtaaaggatcattattagaatatcgcatgcaaagactgatgttccatatgggatattatagcaaaagaggagttattataaagacatctgctgatgatttggcagatgaaattacagatcttgatgtctatgggatatttatcaataaggatttttctacaaaaaaggtgtgggttgattgcaaagctggaagagcaaaaccgctagaacgaatgtcttggatcaaaggtataaaatattctgctagaatcgatgaagctatatttgtaaaaaacaatgttagaattaatacaaaacagtacgcacataaaagtggaataattattttggatgatgtgttgttaaataaattggaaacagattttcatattaaagaaagtgactggagggggtcttggaattataatcaacagttagatatgatcaataaactgaaaaaaagtgtatcatatgatggtaaggaattaaaaagagtagctcagtatatggaaagtagctattgggtatttgatcattatgcaagagtaaaaaaatgtttgagtggaataaaacaattatatgattgctacaatgtagaaggtgatgagaaaaaagtaattatgaaatggggtatatatgaattaatatgtttgtttaatttagcaataataaatatttgtcgagaagtatattatttgtcagataatgataaaaagttactgattatggatgggatgctatctggtgaaattccagcaagaaagcgagaagaaatagtaaatgcaacatacaagatggccattggattagttaaacagcaaatacctgactttatgccacaacaattacatgctaattttaaaattgaaccaccagaatatacttataagcttatagattttatttttagaataacgaataacccgttggcattttttgatatactgcgacaaatcgaatttatactaatggaatatgaattgaatgaaaaagtggttaataatgaggagatgtcctctttatttgataattatgagaaagttaaaatcggaataaaaacaagtttgcattttatttgtgatgtttgcaatattccaactacgttctttaaatatctaagttctaaatagtctaaagaatcgggggaggggataaaaaatatcgttatcatctgcgcacatggactgactggaatcaaggaggtaatagctattatttatcctaaaacagaatgtgagtgctacatccactaggtacgaaaacattaaaatgtgcctgattaggagtgtgagtcttttgctgcagacttaaagatatatcagatatttatgtaaaaaaagactttagaatagttggagcgagtcacagaaaagtgcggatacaaatccgtaactgggatcatgtatatggagaactgagaatggtgtacggagggggcccaatgaagttattataatcgtgtgaaagacggacgaaaatatcgcctgtttataatatacttaaataggtaggggatatcatgagccaagggctgaaatcctatcaagaagtagcttttctggatattccgtttaaatagtgcactctttccgaaatttcagagcacataaatccgggggttcagagcaggtgtttccgctccagagtgcaatcctctataatgaatccatgcacatgaaaatgtgtaaattcattaaggaggtcgataaccatgattgattatcgagaaatcatcagactaaaaagtctggccttaagcaatcttgcgattacgaacagcttgtgttgttcacgtaacacggtttctgaagtacttaagcttgcagaaacacattctttgggatggcctatcccagatgcactgactaacagtgacattgagcatctgttttatccgaacagaggcagcaatgaaggaagggggctcccggattacgagtatgtctatcatgagctggctaagcccggtctatcactttctctcttgtggacggaatactgtgccaaatgcgaggcggaacatactattccgtaccagcacacgcagtttaacgacaagtatcatgcttatgccgcatcaaagaaagcaactcttagaattaaacgcaaacccggagaaactctggaagtagactgggttggcgatacccttaaggtttacgacgtcgccagttgtcgcgatatacctgcctatatatttgttgccgtacttccgtgcagtttgtacggatatgcagaggctttttcagatatgaaatccaaccactagataggcgcacatgttcatgcgtattctttctttggtggtgtgacccgcattctcgtaccagacaatctaaaaaccggtgttattaagaacacatggacagagcttgtactcaaccgttcctactatgaaatggcggaacattatggaactgcaatcattcccgccagaccggtaaagcccaaggacaaacccaatgcagagggtaccataaaggtacttgaaacatgaattttagcagctcttagaaaccggaagttcttcacctttgatgaactcaacaaagccattcgtgaaaagctggaagaattcaatgcaaaacctttccagaaaaagaaaggaagccggttgtctgcatttatcgaagaagaaaaggacttcctcatgccattacccgcttccccgtatgaaacggctgtctgggggctgccaccatacaaccagattatctcctaactgtcgggaattgcaagtactctgttccatatgaatttattggtaagaaagtagacatccgtattactgaaaatagtatcgaagtcttctatcataacaaccgtatagcagctcacgtgcgtaaagcgtattcgcatgattcaatttacatgccggaacacatgccggaaaatcacagaaaatattttgaatacaacacggaaagttttcttgactggggcaggaatgtcggtcattacaccctcattgtagtaaaacattttttatatatgcataaagtggagcaacagggatataaatcctgtgcatcgttgatgaagcttgctgaccgttatggtatggaacgtctggaaaacacctgtgccaaagcgctcagctacacaccgagcccaagtctgaaaaatatcagcactattctgaaaaacggtcagggcaaagtggcattggaatcagaatccggtaacttatcaaacaaagaaagctccaagtatggcattaccagaggcgcttcttactacgaaggaggtgaccgctgatgattcgccagtcaacaatagataaactacacgatatgcgcttatctgtaatgtcagacgcttttgaaagccagtgctcagaccctgatacctatcaggctttatcctttgaagaccgttttggaatgctggtcgacaaggaatgggacaagtgaaaaaatacaaagttgcaaaagcttatccctaatacagaattccgttatccgaatgcgtgcatggaagccgttgagtatcacttggacagaaatctggacaaaggccagatgttggaattctctatatgccggtatatttcagataaccatcatatcattatgaaaggtgcatccgggaacggaaaaacatacattgcctgtgcacttggtatagcagcctgccggaattttataaaagtccgttatgtccgcttgtcggacctgttaaacgaactggcagttgcgcatggtgatgatactctgaaaaaagtaatcaaggcgtaccagaaaatcgaccttttgattctggatgaattccttttaagcccggtatccaccgagcagacacgggagcttctcgaaatcattgaagcacgcagtgtaaaaagttccgttatcttctgcacacagtttgaaccgaaaggctggtacagccgtattggaagtgattgcgatgctactatctgcggagcaatcattgaccggattattcataactcctatgaagtaatgattgacggtcgtgtatctatgagggaacgtcatggcatcaaagcttcccggaaaggagctgccaatgactaactattgtgcattcagcaagaacaataaatgtattaaatggactgattacgaattaacccgccacgaattagaagaagctgatgaactatgtcatggcaactggatagaaatccagcacctgcgaaattacatcgaacagttacaggcacttttaacggagcacggaatagagattccatctgagtactaatcagctaactgcactcggctccggaaaggcatgcaccgcttttccggaaaaaggtgctctaaatttccgaaaagggtgctcatttcagacggaatactcagcttttcctctcatcatataggatttcaatcaaattaacggggtgagggcctattttgtcatgtggtataaacagtatatatcaacacatgttgaaaccgtttgtctgatgttaagaccgggtgagaatagcgtaaaacagggcgttttgaaccgctttcggtgagatttattaggattggaaacttagcagttcgctctgtggaaacagcgctaccggctgattatgaagaatgagccgaatagttgagtcgttgatttagatgtcgtctattgagacagtgatttaggtgtcggcgagagttgagttcccggattagatgatggtgtcgaggatgaatgctgggaggtggtcgtgtggctggaaagaaaaaactggtagaaaccatagggaatccttacacgggcgagcatgctaaaattaccgcaacaactgaaagtgccctgaataaaaaaatagaaactcagtataaaaatggggtgctgaacaaataaagtgggaaaaagaacaagaaaaaatcgaacaagagagatatcaatttgaacgacaagaagaagcatatagattaagccgccagtgctctaaagatttatctgctataaagcacagacttctaattggagtcacggaagcctctgttccggaatactatgaaagccttaaacgtgtcagaaggtacactcaaattcatcaaactcctaacttggatataatgaagaaagacctgaaggttccgaagagaattgcttttattgagtcagtcttcccaaagcgaaaagtaaatagaatccaattagaggatctggcgaaaaaagaatataacaagtgggttcaagagtatgagcaaggaaaaatttcttatgaagcggaacaggcccagtttaatgcaggaattgacagcaggcagaaagattgccatgatggtaaaccgagtgaggttatggaatatatcctttatgttttaagtaaggatagcaagaaaacacgtggatattacatgggatttcaaccaaacaacaccgtgttctatagggaggggcttcttgtgattaatggagagttgccggttatcgattccttgccttattctgattataaattcaatataagagatgatgaaattattcctatccagttaaaacgtgatgaggccaagaatatatataacggcatgatttacaatttggcattgcgtatggtggcagcagtgtttctctctgatagtagtggaataattaataaaataattttcaatggatataaaacacgacttgacacgagctatggaaaatatatcgatgattgccttctaagttttcagatatcaaggcaggtgtttgacgaaattcatattgtaaacgccgacggcaaagccgttattaatagaattagcgggaaaataccagaagatttcgcaaaagatacacctacaataatggaaccaatatttgatgataagagtttgaataaactctatcttagggagtaacaaaaataaagagggcaagtcaccctgtcgaatttcttcagggaaacctgatctcttatccgttaatatcaatactgataccagaattgaatttgcaaagtaagcgtcagataaagtcatgtattaaaaaagagccaaccttccattataattaaaggttgactctatcgacacagtttctggatcagcggattccagagcatgtattcttccaggtattccggatattccaaaaacgaagttccgggaatatcatcaagaataaactggatttatttcattggactcagaccattgacctttgctgtttcaatcagggtgtatattacagcgcttgcctccgcacctttggggctaccagagaacatcctgttctctctgccaattgtaaaaggacgaatactattttcctccaggttattttgatatgatgcagttcccatccagcaggtaatgataagtcctgctttctgattggctgcataagtgaatgcttttccaatttggtcgtgggtaaaagagacctcaccgaaagtccttgtgagttccagactgggtaaatccattcagtatgcgaataaccaaaaagaaggactgatgaattatcttcttaatggcaactgcagcatatcaaacaatctggcagagaatagcatccggccatttacaattggccggaagaactggctgttctcaggaagtcccaaaggagcagaagcaagtgctggtatctatactctaattgaaacggccaaagccaatggattaaatccatggaagtatatccaattcattctcagcaatattcccggaacttcattccttgaatatccagaatatctggaagcatatatgccatgggatccgattattcaaaaactttgccgttaactgacagccttcaattataaacaggggctgtctgtttttctatacaccaacttatttgacacttactttcattcagttgtaatccttcttaataatggtgtataatgactttatgtatcttaatagaaaactttatagagaaaatatcgttgaatcattatatgaatatgaattgaggaaggaaatttattgactaatggatttttctataagaccaagagaaactagggatagaaatatagctagaagatatgtagagtcattcgatttactcagttgtttaaaacaattagaggttagcgaaaaagatatcctgcaggccagaaaagagtatcctcttagatagtgtcaagattttttcgcaaattgtatttcaaccgtctggtagccggtagttagccggctatgatatcagactcgttttggagatccatttcttttagatgctccatattcatgtagcgctttgtaccccattgggtccctgctacgtgtcgtagtctggcacatacaagcattaaagcactttgcccatcaggaaaagcgccaattgcccgggttctacgtttgatttccctattaagtctttcgatggtgttgttggtgcgaattctagtccagtgctggctaggaaaatccatgtatgtaagggtttcctcgattccgtcttcgacctttttagctgccgaagctaatttcatctcgcgaagtttatcagctacttgttttgccttttcctttgcagataccttacactcttgagcatgaatagcctttagcagcatagagacttctttcatcttattacgaggagtggccgaaaatatattccgatagaagtgaaccgtacatctttgatactttgcatccggaaatacttctggaatggattcgagcatcccaaggcatttatcaccaataattaggcgcactccagccaggccacgttcttttaaccatacaaagaatgtcctccagctttcacgatcttctttcataccttctgctgtgccaatgatttcacggcatccatcttcattgacaccaatagcaacaaggatagagacattttgaacttcaccaccccagctgcgctttaagtaaacaccgtcaacataaacatatggataagaaccgctaagtttgcggcttctccatgtttcaatgtgttcataagcttttttattaagattacttattgttccaggtgaaattttagttccccataatgcctcggtgatatcttcaacacggcgaacagaaacacccgcgagatacatttcaatgagagcctcttctacggagcattctctgcggcgatagcgttcaataatggcagtttcgaacggaacaccctttagctttggcatctttaatttgacctcaccagctgtggtttgaaagttcctgctgtaatggccggaacgatatcccttgcgttcaccggaacgttcgtatttttccgcattaacgagttcttctgcttcatgatccagcaaggcattgagggtttcctcaacgctgttgcgtactaaatctttcaattcgttatggataagttcctgatttaattgtataatattatcagacatgttctatagcctcctttgagagtattttgtgtggtaacttaattctaccaaacggctatagaccatgtctatttttatgaaattaaatttgcgaaattaattatacgtcatcaggcataatcatgctttcctataatcttttttacacactccagaaatgttgaaacggtgataaggatgacatattgtagtaataaggacgaaaatcaggattagatcacaagatgttgtgtttttttgcttgaaaatgaggaaaaacggagctgaaaaatgcgattttgggccccgttttttcgctgtgtccacggatggcataagatgtttgaagataaaacctttttaaattaataaataggagaggtgaaaaaattatcttaattgggaatttattgactaaatttcccccatagttatttccttctcttttttaagacaaaagtgtctctactaatcccgtgccaaatacgatataatcagagcataaaggaggggaaaatatggagtcatttgcaaaaaaaataaaagaattgagagtggcagctggactcactcaagaaaatcttgcaagacagttagacgtcacaatgaaatcaatacaaaggtatgagggaggatataggccagacacttatgctttagttaaacttgcaacattttttaatgtttccgcagattatttgcttggattgaagggctataaagaagagatagaggagcgcgagtataaattaaagggagaagacggttacaatcaattatacagccattatttgaagtgtttgaataattatgaaataaaaaaagaagcgacgtatttttggattaatttgaaagatgattatattggaggacaaactcaatgggtaggatgggcagatgataaatataaattagaaatcagaagattacgaccagtaaagccaaaggaagcgatagaaacttgtacacaagttatgggaaaacctatggttattaatagtgagctagatgctactgttttcttaatatatgggggagaggcaatagtacgagcagatatatgtgagcaatatttacctgaatttttgaaggattttatcagagaaagtccataaataaatgtattaataaaacaagatttaaagtaaaataccgccacttcaattatggtcataaattaatcttttataagtattattttttatcttatagaaaaatttataaaaatataaaacaaggaatatttgatattttatactatatttaatatggagatagggtgacaatatgttagaagcaattacataccaggaaatgttaagagatataaataataatcaaattaaagaagatacaattggaattcttattacaagacctgagttagaggtaggtgaagatatcttgaaaagtctaaatcattaccatcaccttagtggaaaaagtaaaaatttttatttaccgggatatggggcttattggtatgggagttatcctgatggaagggtagttactaaaatagatggtattgattggtcatttagtgatagggtgtttattaattttattaacgagcttgagcagtatagcacctggaaatattcgggagaaagcgagcttcttatgattgaatataaagatggtatagtatcttttgaaaatatgatgcgattttatttggataatatgcttcgtgatggagcgattgtatctgtgccagcattctttcaacaattattcaggatactaagtgataagagatcaaatagcgaaattagcaatatgctaggtatgaacaaagcgtttcaaataacaaaacaaacggtattagacaatataccacctgttctgtctaaaatctttacacaggaaaagtatttttgtgtaaaaaattataataaatagttatggatattcaaacatttaacagaaaggaaaaatactgaaactcagaaataatgatgcttgtcaaggacaagggtaagcgcttaataaaagagtgcctttaaaattaaaaacaggatcagttataataaccaaccctgagccttacctcttacattcactttgtacatccgctgaccacggcatcagatcatcaagtaattctggatggtttcgccaatcagtgtcaggcatgtaaagtaataaatactctaagtaggtatatacattaagaccatttgcttttgcggtctcgacgtactgtatacagcagcagacgcattcgctccttttggagtgtctgcgaacagccagttttttcgccccacggtaaatggacgaatggcattttcagctgcattgtttgaaatggaacatctcccatcaagaagataattctccatgtaaggtttctggttctttgcatagacaactgcctttccaagggcagatcccttgagataattaaggttatcaagccaacaccaaaaggcctcaagaactggtttttctagttcaagacgcttgcttaatcgttcttctgtggtaagatcttttaatccttcttcgattttaaaaagctgattgcagtaatcccttccgatttcagcctgagtcaatgaagcccctcggctttctttgtagagatggcttctacaaattttcttcgtaggtgagcccaacagccgcaacgggttattccggaaagtttgttgtatccggagtatccatctgaatggacataccctttgaagttcttcaggaagtttactgcattgtccccgtttcgggaaggctggtaatcgtaaagaacaattggttcttttccatcattaccggtacagtataaccacatgtaagatttcgtctgtggtttcttaccctcctccttaaggacttggacaggcgtttcatcgcaatggagaatatcgcgttccaacagcttttgctgaaggtggtcgatgattggtttaaaatagtcatccgagcatcgaataatccagttagccatagttgctctgcttagagcaatccccagctgttcccaatccttttcctgtcggtaaagagggatgctattgacatacttttggtacatgacatttgccacggaactcgcagatgcaagggaatgattcataagtgatgttggagtttctgccttcacaatatatggatgctcagagcgcttacatttcgaacattcataaacagtctgtatgtacctgacgatccgaagttttgccggaatgtattccagctcttcacgcagaacctgtgtaccaagtacttttaatggtgtaccacactgatcacagaactgctcatcttctggtagtgtacacggaacttctcttataggaagatctttgatcagttcttcgcgtttggtttttgtatttttacgtttataacctttgacgtcctttactataggctcaggaagagaagcatctgcttccatttcagcttcgttgaataaagaaagctgaccatcgatttcttcctttggagttttttcactggaagaaccaaacttctctttacggagaaacaggactatttcatttaagttgcttatctgattctgtaggtcttgtattgtgttttcgaggtgcatgatataagcctctttattgtccattatagtttcaaccctatatttttgatacaataattataccacaaaagtagctaaaaagccagtgaatacaggcttttctggcactggaagctaacagaacgaagccggtttagctggcagaataaccgttttctgttccagttcaagaccttccatcagccagcggaactgttgccatgtgataggctttacgtcttcctccgagcgcggccagcggaagcttccattctccaggcgcttgtataaaaggcagaatccatctccttcccacagcaggcatttgatcctgtcacggcgttttccacagaataggtaaagtgatggggtaaaaggatttaagtgaaactgctcctgtacgacagcggcaagtccgtcaatcgacttacgcatatcggtataaccgcaggcaatgtaaatgtcctttgcaatagtaatatctcctaacataagcagttcagtgcaaggagcacagtctcaatgatctgctgcgtggcaccattgtgtatttcaagtgatgcagccggaagatgtatgattacagcagcttgtgtatgaataggtgtttgcacctccaactttttaaataaaaccggtttctccattggatcaggcagtgctacaggaatcttttcgatttcctgttcacgaatcttcttaaggtaataataataggactgttctttgaaaccattctggtcacaccaggtcttaacgggaaggccactggcctggcattccgcaatgatctttttccattgttctctgcggaataaaacttttgtttgagtaacttgatccataaatgcctccattcctagagcttgaaaaacttgaaaaactataactcaaaaagctctaattatatggaattaattatgacatggatcttaatcattatataataagcactgttttattaagcgcttacggacaaggtggtaaaattgctaaaaacagcctgacgccaaggggatactaggtgcaatggtcatccgaattacagaaacagggaatgtcgaaaccatagtattgctggagaagaaaagccagtaatcaaagggtttagggagtttaggcgagatatttaggtgtgcttttgtggttaattggggtgaaatatattttgggttaccgtggtggggtaaggagaataaacgttttggtaaaagaaagggggcttacttttaatggcttaataatgccaataaaaggattagaaaatgagatatgagccagagcacttttattttgattttaattatttagaacggaaaaatattagtcatgaagaggttaaaaagtatacacgttgggtagattcaaatttctcaaagctttgtaataatgggtgggacagccatctcaatgtagaatggataataagaacatataagtcagcaaaaatggtaatggcttcaacattgatgttaaatacggcatcttattgtattgagcataatgcttttattgcagtaccgtatctcctttattacgctttatttaatatatccagatcattagtttttgtggatccacatcaaccttggagtagtattgaaaaattatcccgaatttcgcattctaaactttctacaataactaaagatattattgctaaattaaatttaaatctttcgtttgaaatttacacaaaaattgaggaattacggaatgatagagaacttttttcttatgcgtttcctgctaatggttatcaaagaaaaattgtttttgagaatgttgtaggatgttgtggaattgtagcagagttagctgaattgacgggatttagaattcagaactatatagaaaagcattatttaaaaacagaagaacaacgtcaagttgccttaaacacatggcaaaaagccgagctttgtgatttagtagaggcgtatacatattcttcaattatagattctgaagatttatatcgtattgattatataaaacggaaacgaaaatttcccgcatcaataatttttacactaaccgaaggaatgacagaagatttttttggtgcatggttatcagagaatgatgaaatactttcagatgattatttcaaaccagatattaactggaatataatatatccaattccttaaaaatattaaaaatagtcaactgcgaataacctgtaagagatggggtaatattttacctcgctccaaatttacataatctgatatgccatgtagtataaaagtttcgtctacaggaatgtgtagacagtggtgttgctgaagcggaaagcctagtaaatcaaagggtttcagggatttgggcaggatatgtaggtgtgcttttgtgattgagcaaggtgaaatatgtttccgattaccgtggtggggtaagggaaataaacgttttggtacaaggtttgaattttgtagaataagcacttttgtcttgtggcttagagataaattggaatttgcaaattaaatttctaaatataaaggagctgatgattttgaacggaaaagatgtaaggataggtgcgggtctattagttgacgatatagacagtatggttcggttctacagagatattttaggcttttatacggagtggactggtggggatttcgcagagtttgaaactaaaagcggtttgttatccctatttatgtatagtaggaaagagttcgtgaaggcaatcggggaaagctatattccaccaaaaggaatcaatcagacgtttgaaattgccctttggttacccagctttgctgatgtggatatggaatatgagcggttatcaaagctgggtctacaatttcctacaggcgaacctatcacctatccttttggcattcgcaacttttatattaccgaccctgagggaaatctacttgaaatcggtagtacgaatgaaacataaattcccagttatatcgaaatttgagagaggtgagataatgataacaggatattactgtacacatattttctccgaaaaaacagaagagcttattgaatattatacacaaatattagaaataccgattatcaaaacagatgatgataatacaaatagtgtttattttggctttttcgaaaatatacctatgatttgtatataggattgaaaaaggtgtaatctagaaccaactggacatcaatcttttgtttttcatgccccaaacctcgattctacaattgaacacatgagagagaaaagtgtcgtattgtccgatgcaattagatatgactggggtacttatgaaactcgtctgaatgatattgatagaaatgagattgaagtaattgagtttgtttgataaacaacttccaatttgtaaggtcgggcaattggctttgccattaattaaaagatattgcaggggaaacggcaacaggtgggggaaaatcttaccccatctaagaatccatcagtttacttctgtcatgtaatataaaacgtccgtctataggaatgatgaaacaatggtaatgataacatattgtggtcaaaagggaagataacacagtttagcgattatgtataaccttgcaagtattttttagaaaagacgttgttgagtgagtttaatacttttttctaagatactattaaattgcatttgtttggcagtacttattcaaagggggtatggaatttttcctttttaatacttaattaaagattaatatgaaaggtgtgatattgtgaagatatatatttcatcagatattgaaggcataagcggaattacggctattaatcaggtattacctggggagcgggattatcagagatcaagagaacttatgactcaagaggtcaatgccgctatcgaaggagcaattgagattggtgcaacagaaattgttgtaaatgatcttcatggtgtcggaactaatatacttatagaatctttaaacagtaaagctcaattaattactggtccatcgcataagggtgcaatgatggaaggattagattcatcgtttgatgcagcaatatttataggctatcattccaggatgaatgtaagtggggttttgagtcactcttttcatggaggtgtgatttcaaatataaatataaatggtaaagatgctggagagttttatatgaatgcatgtgttgcaggtcattttaatgttccagttgttttagtatcaggtgacaacattctggagcaggaagtaaaagacataaattctgcaattgaaacagttgtagtcaaaacatcatatggaagatatgcagcaaaatgtttaacaccatctgtagcatctgaaaaaataatggaaaaaagtaaagtggctttattgaatgcaagaaatattaaccctataaaaatacaagggccacttgaaatgagagttactttccttaacagcggtcaagccgaatcagcatcaataatgcctggaacagagcttgttagccccaatattgtattatatagtggaaaaacaattattgatatctatagagcattaacagctatgataaaaatcgcaaatagcaattaatatatttattgatgttgaaaggtgcaaacagctgttttttagtaaatattgattttatgaatcaaatactggaggatattcaaaattcggaaaatagattaagaaaaaaatatgatggagtccaatatgaaaatcggattgatacaaatgccagttgcaagtgaaaaagaaaagaacctttcatatgctgtacagagcatttacgagtgtaccaaacaaggcgcagagttgattatacttcctgaaatgtttatgtgcccttatgccaataaggactttccagtctatgccgaacaagcaggagaacagacgtggaaaacgctgtctgatgcggcaaaaaataacggtgtatttcttattggcggaagtatgcctgaaagagatggaaaccagatattcaatacttcgtttgtatttgcccctaatggaaacgaagtggcaagacacagaaaaattcatctttttgacattgacgtaaaaggcggacagagctttaaagaatctgatgttttttctccaggagacagcattactatgtttgaagttttcggtattaaaataggtctttgtctctgttttgatatgcgattccctgagcttagcagtattatgacattgaatggtgtgcagatgatcgttgttcctgctgcttttaatatgacaacgggtcctgctcattgggaacttttattccgccagagagcagttgataaccaattatatactattggtgtggcccctgccagggatgaaaatggtccttacatttcatatggaaattcgattgtggcatcaccatggggagacgttatttaccgtgctgatgaaaagccgataatcattgtaattgatattgatttggaaatgaacaaaagtatacgaagtcaattgcctcttttgagtgccagaagaacggacctatacaaagttgaggaaatatagactatgctgtaggcgcacgatgtgacagagccattcaaaaagagacctacagcctcttttaggtggaaaagtaagtggttcgccaaggtcaaactatgtcttacgagaatccgaattgctgcctcaacaaatacagaatgttgtattctgttgcaacgggaggagaattagaaaaatgaatatctgatatacaaacagcgtaaaggttgttcaagcctttacgctgtttgtatatgaaggaaagaaaaataaataaagaaggttataaaattgtcagtaagtgatttggagaatagtgtaaatcaaaagaaacgggttgcgtcctactgatgtatcagcacgaaatttgaagaacagcacaaaagtttagaaatgcaaatgagttactataaaaatttaattttaataattcagagtgggaattcgcaggcatttttttcgattgcgaaagtggtctgagaaaatccaggtgtagtggattaattgattggatggcaattgtgcgagccggacatatcgattgtatatgtacgttaaggtgaattatgagtaaatcagataggataagcgtttttatctcttttgtcttaagacataaactaaatgctgctaatataaaatagacaagtgtgatatgctccaagagtagatttttgtgtagaagtgtaagataatgaacagggtgtataaaaaaatctaattacagaaaatatttattgacaaaaatcgagagggaattgacctcccttaggcatacgcatttttgttatcatacaacaataaaagcaaaaaatcagctcaattgtaaatcgaaatgcaacccttccgattccaaattgagataaaatttataaattagatatagataccagaaggttgcattctggcttacaaaaatgattgatgttctttcattgaatgttgagattaccagtcttttccgtttccttagattgcttgattcctatatcctaaaagagttggcggcagaacggaggatattggatgtctaaattttttacttacgaagacaggctcagcctgcaaaaatatcttaaagattctttgtcatttatggagatcgcacgccgcatggataaaaatccaactaccatctccagagaagtgcgtaaatacagctcgcacattgccactggttatcccgggtttcctttcaatgcctgtaaaagcagattcgattgccggaagaaaaaaatctgtggaaaagaatgtactcgtaaatcagatagctactgtaagctgtgccagtcctgtaatgcgaattgcacagacttccttgaagaaatctgtatggcaagatttcgggcaccctatgtctgcaatggttgccaaaccattggtaagtgcactcttctgaaaactgtttatgatgcagagcatgctcacatccacgcacatgagaagatttctgcctcaaggagcggtctttgtgtttcagaagaggaaatcagcaggctcaaccatatcattactcctctcgtggaacaggggcaatcggtcaaccagatctatatcaatcaccaggatgaattgatgtgcagtgaaaagaccatctataactacattgatgcatgtttgtttgacatcagaaacattgatctgccaagaaaagtaaagttccgggagcgatacaaaaagccggaattcaaagttgataaaggctgccggatcgaccgcaattataagaatttctgtgagttccttgagaaatcccctgacacgaaccttgtgcaaatggactctgtcatcggggaaaaaggaggcaaatgccttcttaccctccactttgtggagtgcagcttcatgcttgcttttttacgtgatgcgaatacttcaaaatcagtaaccgttatttttgataacctgcatcagacactggagcataagctgtttaaaaagctgtttccagtaattctgactgacaatggaagtgaattctcaaatccgaaagcaattgagtatgggccagaccgtttcgccggcttaaggaccagagtattttattgtgatgctgggagtccataccaaaagggggcgatcgaagtaaatcatgaactgatacgcagagtccttcccaaaggaaaaagctttaacaatcttacacaggatgatatcagcttgatgatgaatcacattaattcttataaaagaaaaagctgaacaatcgtagtccctacgaaaccttcagcttttatcatggagaagaggttttactaaaacttggatgtaatccggttgcccccggagacatcatgctaaaacctgttctactcaaaaaataataaatttgcatgccgccaacgtctaatctgtctaaggaattaggggtggattctccgattacaaaaaaatcgagagggaattgacctcccttaggcatacgcatttttattatcatacaacaataaaagcaaaaaatcaaactgcatttcagtcacaaaggtggcttctggtttacaaaacatgcatttcgagtacaaaagtggcttttcggttacaaatattcaattgtcatttacaaagatggcttttcgagttacaaagtggcatctcatcttgcatttgagttgatggacagggtgcataaaaaaaatgtttctatttgcagaaaatatttattgacaaacgataaatatttgtttataatcaagtaaatcataaagagagaggtgctttcatgaaacgctgttcgactatcatccttcgttgtgctgttgttttcgctggagttgtcatgcttgccatatgtggtgttattgcatggattgctttttttgaaaacaggcctgatccatatcacatggaatatatcgggtttattgggacatacgcagcggccacaccctattatatcgcgctgcatcaagcaatgaaattgttgaaatatattgacacaggctgtgcgttttcggaattgtctgtaaagtctttggatattattacacgctgcgctattgttgtttttattattgttacagtgggaggattgcctttcttttatacactggtgcaattagacgatgatacaccggggtttgtgttactgggcttgctaatatcgggtagcgcatttttaattgccgtttttacttctgtattgaaacgacttttacaggacgctgtcgatgtcaaatcggaaaatgatttgacgatatgaggtgacgaatatggcaattgtagtgaatgttgatgtcatgctggctaaaagaaaaatgagtgttacagaactttcggagggtgttgggataacaatggctaacctttcaatattaaaaaatggcaaagcaaaagcgatccggttttcaactttagaagctatttgcagagtgttagaatgtcagcctggtgatattttggaatataagaatagctgagtgcaaagatgcggtttgtctttccacagtagagaggtaaagcctgtggaaaaagagaaatggcttctttgttctgtttgtaagaataagacgcgaatacggataagaaatgacacggaattaaaagctttctcaaagattacagaggccttctgataaagctattctacagtcttctttggttgaatgggcataagaaatgaggttagttgggaatcaaggagctcattttgacccggcagaaatggtgagtatggatgatgtgatgcagtttatgtcatttacaaatattaagcgccagaatttctggaaatatgctcttacgccaagggagtattaggatcaatggacatcagaattacagcaacagggaatacagaatgttgcgttctgttgcaacgggaagcaaattagtaaaataaatacttgatacacaaacagcgtgaaggtttgaacaaccttcacgctgtttgtgtatcaaggaaaggaaaatatataaaaaggttataaaattaccattgaaacgggttccggcctactgccaactgccgtatcagcacgaaatttgaagaacagcacaaaagattagaaatggaaatgagttactataaaaatatgatcatgagtgcgtatataaaaatctccaggccatcggtattggaagtattgccgtgcatgattgctttgtcagagaacttgctggagagtatcccattcttaaacaattggaagtaactgaaattaatgtatataaattgggctatcttgttaaacggctctgccttgaataagaattcatgattttaaataatatacagagctcgcttacagttttgtatctgtttaagaacacaaattaacactaaaaagtcaatatcaggatatcaaagtatatgattagggtatataatactttttagttagtttacactaactgacgcgttcaagggcatgacgggagaaaacaaagaaagaggatgaattatgtgtagtgaacagctaaaagtattatcctggcctgataaacgctgtgatggtgaatacgaaatctgcaatcggtgcagccctgagaatgcacggtggaatgaatctaaatcagagcttaccttcagagcgcaggagatcatgcatgaaacattccctcggaaatttgatctgagttatatttcgaacagattgttcgtaaataaaagctacttgtgcagagtatttaagaaggaaaccggaatgacgctgctgcaatattacaatgaaatacgctgtgaacatgccaggaggctgctgatacattctaagctcggcgtttcttatatagccatccaggtcggattctgcaacctgtcacaattttgttatgtattcaaaaaggttgtcggaacaacaccttgtgaatacagaaaatcatatttaaaagctttgaaggaaaagtaagcggtctaagcatgtatgtgcggatcataagcggcttcgcaggacggatatgcagaacaatgaacacatcacccagtaattatacaggaggagcaggtatgcatggctataaaaatattagtccacacaaccaccccggtgtgcgctctgagaatgccagaaaacagaaggaatatctctggagcagcagacagcagtctgccgatcgagcggacagaaacaaaatggcaactgattggaagcctgaatcaatgaggcttccaccagataagaaaaaacagatagaaaggcggcatgtgtcagaatatgaaatccgaccatacagcgagtaatcttttatcagtccttttactggcactgagtatttttttgacctttggcacacaatttttgtttcatgcctgcagcgttaaggaggatggcagctacatgctgtgccactgggcgcagcgcgcggtgacgggtacgggcgcagtcctgatcatcttgtacattctttgcatgatagcaaaggaccgaaagatcaaagcggcatttatcacggccgggataccggtcactatccttgctatgctgtttcctgatgtgctgatatctatgtgtatgtcagataccatgagatgtcatgcggtcatgcgtccagctgttctggcggtctgctgtgcgattttgataataactgctgtatcgctgccggtgaaccttaggaggaagaggtgacatgtcaatttttaaaagtcttccggttcgcaactgtctgcacagacctgtaagaacagcggcgatgacagcgttgtcggcacttttaagcttttccgtgctggcaggatcattgatgatatcaggtctgaaaaacggattgaactctttggaaacgcgcttgggagctgatatcatggtggttccttacgaggcggtcacgaagtccgctctaacaggattaattcttcagggtaatccgggatatttctacatggataaatcgtatgtagacagactgtctaaggtgagcggtatcgggcagatgtcagaacagttctttctggcctcgtccacatccagctgctgctcttacaaagtgcagatcataggatttgatccggcaacagattttacgattcttccgtgggcacagcgtacatataacaaaaaacttggctatatggaggtgctggtgggcagcggcctcaatgcatttatgggggatgaactgacgttttacggctcagatgtaagtgtggcggcaaagcttgataaaaccggaacttatctggattcggctgtatatgccaacgaagataccataaaaaccctgatttcagcagcaaaggaaaagaagatattcgattttggcagcgttgatccggaacagatcgtatcttctgtgctgatcaatgtggctgacggttactctgctgaagaggttctcaatgatatcaatatccatgtaagaggcgtagaggcggttcaaacacagaatatggtctctgatgtggcgggtaagctttcgggcatttcggatattgctggagcactggtagtggtggtgtggctgttggtgctgacgattatggcaatcgcattttttgtgctgtcaaatgagagaaaaaaagaatttgcagtacttcgccttgcgggtgcctcaaggaaaaagctgattaccattttaatgggagagacgatactggtcagcgtgtcaggaagcaccgccggagctgcctttgcggttcttatggtctctttattcagcagcctgattgaaacatctttgaatctgccgtttctgattccggggaccgggaggctctggatgatggctctctgtgcgattggcgtttccgttgcagcgagttcagcgtcggcctcatttagtgcatacagaatcagcagaatggatacggcgctggtaatgagaggtgataacggatgattttgcaggcggaaaaaataaataaaaggttcatgcgaaaaaacggcggaagcaattttttctatgctgtacaggatatgtcgctgtcacttaattccggacagctcatcgctttattcggacgttcaggcagcggtaaaagtacgcttcttaatatattgtcaggtcttttaaaacccagcaatggctgcgtaaaactggatgatgacgagctgtacagtatggatgacagcaggctgtctcaataccgtaatgagcattttggagttattccccagggacaagctgcattacagtcactttcagtattggataatgtacttttgccgtgcacgctgttccgtgcagccgataccggcgaagaagagcgggctatggcgcttcttgaagagaccggcataggtaatttaagagatgtaagaccgtcagatctgtcaggaggagagatgaggcgcatggcaattgccagggcgcttatacgaaacccggatgtaatcctggctgatgaaccgacagctgatttagacgatgaaaatacagagatcgttctaaagcttttgagaaatatggcggaccaggggaagatagtttttgtagcaacccatgacaaggatacatttggttatgccgattctatctatcgcatggatgccggaataattaagaaagaaaggtggatttgatgcaaagaaaagaagtcaggataaacaggctgattgccatgctcatcatggtgtgctgcctgcttacttatatgacacagactgtgcatgcagaggagtcttactatgctacctgggctgaataccaggagtcggggcagcctgcttcgacctggaatgatgtggtagatgccatggaggctgtatttgagacaggcaaggagtactatgcagcaggagatgccaaggcggcctatgattgtatcaatcatggctattatgggtattatgaaacgaccggttttgaacggatagctatggggtatatatccggctcccgaaagacagagatggagctgcaattttcggcctgtaaagccatagccaaaaaagggggcagtatcgatgatttcaatgaagaggtagatctgcttgcatcaatgcttcgtgaggatgccaatgttttagatggaacagcatccggcgatgattcttctggctcatcatcatcgtcttcgggcggaacatctgcagctgtagcaacatttaccgcgtgtttttcgatcatactaagggaaggctttgaagctatcctcatcgtaggcgccatcatagcatatctggtaaagtctgcgggtgatgacagaaagcgccgcaggaagctggtgactccggtctatataggatcggccgtaggtatagtggggagcttcgtgcttgcatggcttttaaaccagctgaaactagccaacagtgcttcacaggaggttatagaaggagttacagctctgacagctgtgtgcgtgcttttctatgtaagcaactggatgctgtctaaatctgagacagatgcatggacttcatatgttaagaccaaaactgagaagtccactgcgagaggaagcagctttgcactgacatttactgcatttttagctgttttcagagagggggcagaggtggtgctgttctaccagccgatgctggcaaacagtaataccggaagcgtatgggcaggtttcataatcggctgtatatgcctggtgttcgtttatcttgcgattcattttctcagcattcagattccgatcaagccattctttactgctaccggcgtgctgatgtcacttatgtccatatcatttttgggcgcaggcattaaggaactgattgagggcgatgtcatcaccatgatgtctcctgaatggctggcatggattccgaccaatgatgttctggatgttctgggcatctacccgacagttcagaccctgcttccgcagctgattcttctggctattgcggtgacactgtttatcatacagaccagaaagaatcgcgccatccatatcgaagcggaaaagaatcgtgcgcaggagcgcctggtacttgaagccgaagaaaagaaagcaaagcatgaggccctgaaaaaagaggtaatggaaatactcgacgagctgcatattcagagagaatgatcctgcagcggaagttttaatcacgctaattcctgagacagcagtatttaacttaactgtccggagttaaaataaatcacctatttaaggaggaaataattatgaataaggcacttgtactgttcatgtgcacatcaattacagcttttgcattaagcggctgcggcaaaggcacagcatctacgactgaagctgaagcaacaacggtagcggcatctgaggcagagaaggtggaggccaatgtcagctctgatgctgcggtagcacccggcgaagctgcaggcttcaccgagtatccgatttttgaggatgaggaagtcggttttatcaatctttctgctgtttatttccagccggtacctatgtctaacggcaatggcaacatagaagacttcgatctccatcttgaggccgacatttcagcgctccagaatgatctgggatttggtgtgggtgactgggttccttacctgactgttgattataagcttacaggctctgacggaaaggttgctgcagaaggaacgttcatggagatgagcgcatctgacggacctcactatggggccaatattgcacttcccaatgcagatacatattctctggagttcacgatacacagccctgaggagaacggttacctgctgcatacagacgctgagacgggcccaggcggttctttcgacaagtattttgatgacggcaatctgacctacacatttgagggttgggattatactcctcaggagtggtaatcgttcttaaaaacactgcgctgtgccgggggaggtatttctgcggcacagcgtttctgttcataacaagttaaatcattcatatttagggcaggtgtacagagtgctaaaatatcttgtggaatcaacagaacagctggcagcgctggctattatggcagggatgcttctggcatatataagaatcgcatatcagggcagagcggcgtttatcatgcggatcggttttatagcaggaatcgtcagtgccatagttatgtctgttactaaaacaatgaccagtaaggtggataccggtatatggaatctttatatctatacagtgtctctggctgtgctggcactgttttttgtgtttacttttttagggaaaagacttaaaaagcaggcagagtaccttccggcagtcatgcttgcgacagaactggccatgctgtttttgtactttttgccggctttttttgaaatgccgcatacgatcctcttaacggaggagacggtcatgtctaccgcttttattgtaaagttcctgggtatgcttttaggttttttactgatcattatcatgggaatatccgtataccaggggatggtgtatatggggaagaatacggcgctggttctgacatcctcagtacttcttataaatgccttaaagcaggttgcctcagcctttggaatacttctggcaaaaaggctgatagcatctaaccacacgttattcgtgatatcgaagtacgcctctaatttaagcgtctggttcatatatatgacgatacttgttgccgtagtggtgcctgtgatactgctgatcagaagctattcagccaatgaaccttatgagaacaatgctcagcgcagaaagattatagccaaatggaggaaactaagacgcttcagcggtctgggtatcctatgttttgcgttcgtgatctgtattatgacggctgttaatgcttatgcaaacaaggaagtcgagctttcacccatagaggaggcaaagattgacggagataatttcacaataccatttgaccaggtaaatgacggacatctgcaccgctttggttataccactgataatgatgttgtcatcagatttattataattcaaaagccgaattcagcctcctatggcataggcctggacgcttgcgagatctgcggtgagacaggttattatgaaaagaatgggcaggtggtctgcaacctatgcgatgttatcatgaatatcaataccataggatttaaaggtggctgtaacccgattcccattgactatagaattgaaaacggcaatattgtagttccggtagaaaggctgctggaacatgaatctgagtttaagtaagggggagaattgtatgttctttaaaatgattcgaggtacacttctccaccagtggaagaagatgcttatgatcgcactgaccatagctctcggttcatcgctggcgacagcgatgataagcgtggtcatggatgtgggagacaaggtcaaccaggagcttaaaacctatggtgccaatatcactgtggtgccggagcagtcctctgtagtgagcagcctctatgatgtcgatggtgagaaaaagggcggtgcatatttaaaagaatcggagcttggcaatataaagaccatattctgggcctttaatatagtggatttcgcaccgtttactaccgtgccggctgatctgtctgatgggactaaagtggaggtggtgggaagctggttcgaccaccatttagatctgccaacgggagaacagctggatgccggtatgagcagcttgcgttcctggtgggatatacgtgaaggacagtggatcgatgaaaaatcggacatgggcatcgatgtagctatggcaggcgcttcattagctgataaaaaaggtataaaggtgggtgaccgtataacgcttaacggcactgcggcatcaaaagaactcaccgtagtgggcatctatgagtccggaggagatgaggacagtcagctctatgtgccgcttggggtggtacaggatctggcggatctgtcaggctgcatcgacagcatagaggtcagcgcactgactacaccggataatgagctggcgaaaaaggcagctaaaaatccctcgtctctgactgtagcacagtatgaggtctggtactgtacagcctatgtcagctccatatgctatcagatccaggaggtcatcacggattcggtagcatcaccggtcaggcaggtggctgattctgaaggcgcaatactcaataagacagaacttcttatgctgctgatcatggtgctgagccttatcggatcggcactgggtatcagtaacctggtgactgccagcgtgatggaacgttcaggtgagataggactgatgaaggcgataggagcctataatcattccgtaaccatactggtgcttaccgaaattctgatcgcatctgtcataggaggaatcgcaggatttttcgcaggcataggctttgctcagataatcggacagagcgtattcggctcggctatcgccatacgaactgtagtcataccgatagtaggcgttctggttattaccgtgacgcttgcaggaagtgttcctgctattcgaatgctgcttggcctgcagccggcagaggtactgcatggcagataaatacagcagcacggaggaaactatattatgaagaaaagaagaatgctgtttcgtatgatcaccgcctcacttttgaggcgcagatcccgtatgctggtggcactgcttgcaatagccataggagccaccatactttcgggacttgtgacaatatatgtagatgtaccgcagcagatgggcacgcagtttcgaagctacggtgcaaatatgatttttatgccggcagcagatagctttactcttgcaaaaatgcaggagagcctcgcagttatcccttcagcagagctggtgggggccgctccgtatcagtacaacaccgtacgaatacatgagcagccgatcatggcagcggggactgagatggctgacgtacaaaaaaccagcccatactggctggtagatgggacatatcccgcttatgcccatgaaatactggtagggaaaaatgttgcccaaagccttgaactcagtattggagacagtgtaagtgttaatttcacaccggaggataagacccagatggacagcaccatcgactttactataaccggaatactgaatacaggcggctctgaagaggaatatgtctatatctccatggaggatatatcagagcttacaggtaagtctgacaacgtggatatagcggaggtcagcgtttctgcatcttcggcacagctgcagaagtatgtggaggaaataaacgaaagcagcaccgcaatcagtgcgaatctggtaaaaagggtcacggcctcggagaccactgtgctctcgaagctgcaggcactggtacttttagtaactgtcatcgtactggcgcttaccatgatatgtgtcgctacgactatgacagcggtagtttcagaaaggcgaagcgaaataggccttaagaaggcaatcggagccacagacaaaggtatcatcactgaattcatgggagaaggagtggtgctcggagcacttggcggcatattgggatcatttgtcggattcgcatttgcacagttcgtaagtgtcaatgtcttcagcagctatatctcgtttcggccgctactcgtaccgattacaatcatagtctcaatcgccgtcacaagcattgcatgcctgattccgatacgcagcgcaacatctgttgacccggcattggtactgaagggagaatgatatatgagtcttttagagtttcagaatgtatttaagatctatggtgacctccatgctcttgacgatgtgaatttctcggtggagaagggcgagtgggtatcaatcatgggcccctcaggctcaggcaaaagcactatgatgaatattatcggctgcatggacaagccctctaaggggcatgtgctgttagacggagtggatgtagcgaaagaaccggccaaaaggcttacagatataaggcgcgataagatcggattgatatttcagcagttccatctggtcaactatctcacggcgctggaaaatgttatgctgtcacagtattatcacagtgttccggatgagaaagaggccatggaagctcttgatcgtgtaggtctggcagaaagagcaagacacctgccgagtcagctttccgggggagagcagcagcgggtatgcgtggcaagagcactgatcaattatccggaaatcatcctcgcagatgaacccacgggtaatttagacgaggccaatgaagagatagtcgtggagctgtttcgcaagctgcatgaggaaggcacgacactgatcgtggtcacccatgaccctgaggtaggagatgtagcgcagaggcagatcgtgctgcgaagcggcaggatagccagacagacggtgaatgagaattttaccggacatatcagattcacagagtgaggcggacttttatgagtttaaaaaatggcataggtttattgatgattatgagctgtatggtttggctgacttcctgcggaggaaataaagcaagctacagcgacggtacctatgaaggacagagctcagtgtatgatgaggaggatggtacaagctatggcaatggttacggagtggttgatattaccataagcggaggagtcataactgaatgcacttttgagacctatgagccggacggtacattaaaagcagaagattatggtatggagggcggtaagataagcaaccgtgattattataacatggcacagaaggctgtagcttcatgtgaaaaatatgcagaccagctggtaaaaggcggcagtgtaaaggaagtagatgctatatccggagctacagttaactatgatctgttcagagaggcagctgaagatgccctaaagcaggccggaagtaagtagataagcgagtatcggagacttggcatgttccggtacgtgtgctttcttaagcagcccgggaatggccatgaatgttatgtcctatacaatatgggatacttatgtgccggattgacagcaaatacttatattccggaggaagcatgataggatataaacagattgctgcagccggaattcttttgcttatgggaatctctgtagctgcggcgacagcaaaaaggcaggatacctcaaaaaagtatgttcgcagcggagtatatgatattgtgcttaaagatgagggcaaaattacagatatcgttcaaaaaagcctaaagcagcatgacagacgtatcacactgaccttttatactgagggcgaatacatgggcgatatcagcctgctggttgaggatctgatgatgaacgcacttgaaatcgatgacaaaccgactgacggggattacatacgctatcagtacggtggctatacattgtcttacagtcatatatggctaggcacacagtacctctataccataagaatagaacccatatattatacaacaccggaacaggaaacgaggacagacagtgcggttaaggaaattctgaaaaagctggatattgatctgtttgcatcggattatgaaaagatacggaaaatccatgattatctgtacagcactgtgacgtatgacatcattcatcagaacaatgataactatcatctggataccacggcctatgcggcactgatcaaccgtactgccagatgccagggctacagcgtggcggcgtacaggctgttaagggaagcgggaatagactgccgaatagtaaagggaactgtggatcatgacggaaccgctcagcttcatgcatggaatcttgtggagctgaacggagcatattataatttggacgtaacctgggataagctgctggaaacggatgattattttttgaaaagtgatcattcaatgccggatcatattagagacagtgagtatgatgcggagagctttaggagcaggtatcctgtggcagaaaatgactattagagagggagaggcggacaaaaacttcgattgccggagagcgttcaaagggcaataaaggattatttacagggtgaaaatgaacagatactctatcttgattgcttgtgggacgaatttcttattaccatactaagtagccaagcacaggaagaaagccgcaatctaagtgagaatactcgttggggtattgtgagaaattttgaacaatgactggttcatttcaaccataaaagttttatgggatacaccaagggtgagaacggaaattttaataaaaatgagcttcatccaagggagcgccaggtgctgtggtcatcagaattacagcagcagggaattgtgaagtttgtgtcaaattatgaagaaagtaatattgaattacatgtaaatttatagccgatagtagataacaagggacagggataataatctgtgccttgttttctattgtgagttttgctttgaacacacggtgaggaggaaatcaacggtaagaacatttgtttgcgttatccataataatatggtatattatctctatcggtagcaataaaaaaattgtgatgaagatgatgatcaattgagtttgtttacaaccgtcaaagattgaaaggaatagacctttaagtgaggcagcttaaatcaaaaaaaggaggcagcgggtatttctcgtaattaaaatgcgtatgaacaaaaatgacaagaaatataaacctgtaaaaataccgggacaaatttctttttttgaagaaaaggaaaatcaattaaagcagtttttgcaaaatgtcacttctgtttcccctgaagatgaggcttttgctgagattgaaattgatggaggaacaaaccgcaatcagacattttctgcacctcaggcacaagcagtaaatcctgtcgttgatgagaatcgtaagatatttaatgaaatgagacaaatagcaagagatatccagattccttttaaattcaattctcatttttatgacaaacaaacacggattaataattccaaagtattctataaacaagctgtttttatgaaggattacgaggatgattacaatggttatgtagagttttcaaactactttccttattaccagcaaatgagttatgcacagctcagaacatatttcacatggcggactgatataaggaaaggtaatgtcacaaacgtttcgttatcatatgcttttgtttatatttacgagctgattcacaatatcggagtggttgattctcaggaaggacttgataagcttatgtttttctggagagctttcaagcgttttaactcttcgattgataaatatgtgattaaatggataaaggactatcatatttattatgacctccccaagccatttaaggaatttgtctgtgaaaataatctgcaagaacattatgccaaagtattcctgtacgaaacagacatgaacgacaactttgatttattttgcaatatttcaaagtatgatatcagaaaatcagttttttttaccgacgatacaaaagggcagctcagagattgtttttgtacagtaatccataaaattagaattatttttaatagagctggtatcatttttgacgatttgattttttatccgacaaataagatgtctgtatggacgccttttaaggatgcattgttttattcagcgattaagataccggataagaaagttgtgttttccgataaagaaatatatatatgttctaaaaacaattggtcttttagctccacgctgtctatgaatagcggtcggcagctcattggctatattatgaaacaaacagaatccgagttacgaaaagttacaaaattcaaacacaagctgtctgctgatattaattcggttgacagagagcttataaaaaagcttgaatctgtgggcctttcccttaaaaatataattcacgaagcggtgaatgagtattacaaagaagcgacaaaaattgttgtatccgtggatgaaacttctcttcataaaataagacttgaagctgataacactcaggaaaaactaatcgtgccagataccgaacctatgatgttttttgaatcaagcacagtagagactagtcctgttatatcgcaaactgttttagccgatgtctctgcagcaaggcaggacaattggacaagtctttttcatatactcggcgaaacagaagtgaatgcgcttaaattaatacttcaaggggatacaaatctgaagcattttgcagatgccaacggagttatgctggaagtgctggctgacagtattaatgaaaaggcgattgacacaatcggtgataacattcttgaacttgacgatagtccgactatatatgaagaatatataaataaaattaaggaaatggtgtaatataatggaaaataaattgccgttaaggatagccaatatactgataaatgcattaaagggcggtgtcgttccccgcataggacttgaatacatcaccgtagggcgaacacaggaaattgcagcaattttacatgatattgaaatgattgaggatggaagtgcttcttttcgatttattgttggtaagtacggcagcggtaagagctttttacttcaaaccatacgcaattatgctacagcaaaaggctttgcagtggttgatgccgacctttcacctgaacgacggtttgcaggaacaaaagggcagggacttgcaacatacaaagaactgatccaaaacctttcaacgaaatcaaagccggatggcggtgcactgccgttgattttggaaaaatggatatcaggaatacaggcgtctataagagcacagtccgaagcagaaggcgaagcgttcaatcgattagttgaaaaacagatatatgccgtagccggttctcttgagggtatggtcaacggtttcgagttcgccaaggcagttgctgcttactggagagcctaccaacaagatgatggcgcaatgaaatcaaatgtactgaagtggtttcgcggtgaatatgcatcccgcaaagaagcaaaggcagatttggatatcaatttcattgttacggatgaaacatggtatgattttttgaaaatatttgctgtttttttagtaaacgccgggtataaaggactattggttttcattgatgaacttgtcaatatctataagattccaaactccatcacaagacaaaacaattatgaaaaaattctgactatgtataacgacgtgttacagggcaaagcaaagcatattggatttttaatcggcggtacacctcagtgcattgaagataaatacagaggtttgttcagttatgaagcccttcggtcccgccttgcagaaggacattttgccactgacgagatgaaggacttaaccgctcccataatcaggctgcaaatgcttacgcaagaagaggtgtatgttctcgttgaaaaactgcgggacattcatgcacagctatacaactatacacctaccatgagtcatgaggatttactgtactttctgacagtggaatataatcgtgttggtgcaggcacacatatcactccgagagaaatcatccgtgatttcattgaacttgtcaatattctgtatcagaacccaaatagaagtgtgtctgatattttaggcagcaacagctttgaaatggccaaaggtggtctgtccgatgaaaccatacacagtgattttttaaatttcgaggtgtaaactaagatggatgtatttaacagacttgctcctttcatacaggatttcatatatcagaacaaatgggaggaattacgtggaattcaggttgcctcttgcgaggtcatttggggcagcgatgacaatttactgctttcctccggcacagcttctggaaaaacagaagcggcttttttacctgtgcttacggaactgtatgagaaaccttcccgttcggtaggcgtaatgtatatttcaccgctgaaagctcttattaacgaccagttcaaacgccttgaccagttacttgttgattcacatattcctgtctgcaaatggcacggtgacgcatcacaaaccaagaaaaatgagttaatcaagcatccggaagggattatccaaatcaccccggaatcacttgaaagccttctgaccaacaagcgtggcgcttgcctccaaatgttctctgatttgcagtttatcattattgatgaagtacatcagtttatgcgcgatgcacgcggtattcagctgttgtgcatcttagaacgccttcaaaagctgactggcgtaaatccaaggcgtatcggcctttcggcaacgctgggtgatgtgtctttcgctcagaactggctcaacacaggaaccggccgtaactgcgctgctcccataacggaagatggaaagaagcgtatcaaacttcatgtggaacgatttattaacctacacgatgagcgtgataccgctgacagcgacgcaagcgataacaaggttgtaacaggcgggaatatgggtgatcgtgagcattacgaatatttatttaaaatgacgcttgataaaaagactatcatctttacaaacagccgggaagaaaccgaacttgttatggcgaatcttcgtgaaattgcgttacaaaaaaaagcgcctgatgtttaccgggttcatcacggaaatgtttctgcgctgctacgcgaaaacacagaagatgagatgaaatcaagtgatgaaaaaattgtcaccggtgcaaccgttacattggagttaggtattgacattggttcgctggatcaggcggtacaggtcggcgcccctcttagcgtttccagctttgcacagcgtcttggcagatgtggacgccgaggtcaggttccgcaactgctattcacttttgttgaagatatccgaattaatccagctgatacactgggacctatcaattgggagtttatccgaacgattgctattattgagctgtatataaaggaccattggatagaaccgatttatccccatcatcatgcgtataaccttctgtaccatcaaacgatgagccacttaaaaagcagtggtgaactgtcccctgcagctcttgcgcaggctatccttactttgggctgctttcgccatatctcccaggaggattataaacagttattgactcatcttatcaatattgagcaattacagcgaacagaacatgggggcttgatgatcggcagagaaggagaaaagattgtaaatagtcatcattttctcacggttttccttgcgccggaatatttgcttgttaaagatgaaaaccgcacaatcggtactgttgataagatttaccccgttggtacccgttttgcattggcgggcatgacatgggaaacagttgatgtcaatacaaaatcaaaggttatttttgttaaaaaggtaccaggcatttctgtagttgactgggacgtggatttcgatgcagagctgcatactgttttagtgaaaaaggtccgcggcattcttcagggtgatatgtcatatccgtacttgagtgagaggtgccgtgaacgattaacggaaatacaatacattgctcgaaatagcggtattttagaaaatctggttacccctctttccgatataaaatacgcggtattcccttgggtggggacacgacagctattaactcttcactacgcgttgttgaaaaggaaaataagaagtaaacatccttggattacttgtgtctatttagaggtgaattttactggaacgaaagaagaattggaatatattatttccgatattataaaatctgatctggatttatatgagcttcctttacctgagaaagtgcagattgacggtaaatataacgagtttattccttttcacttactgcgcaaacaatttattgaggactatttggattttgaagggttaaaagaggcatttgagtacaggagggctgtatttatggggaacaatgtggaagcccaagagaactgaatgatattttcaaggccaaccacaggaattaccgctacagcaggaatcggaataaaattgtttagttgataataaaagagaacatgaaagaagggccacatatttgacgtatatcaaaaaaacatgatataatataaaatactgacaaaagctatatctgatgcatattatagagcggcgaggatgacggaatgaatcagaaccggggaattaaccaggatgtgacacaggagatgaatcggtctctccttttaaaaagtttaagaagagaaggcgtatgctccagggcacatctggcggcacttacagggctcaaacaggcgactgtgacaaacatcatgaaagatttcctgaattggggaatcgtaaaggaggttggtttcttaaatggcagcaaagggcgccggtcgattggagtgtccatcaatcctgacggctaccgggtcattggcgtgcggcttgcgagaaagcattacagtgtgggactgtttgatttgacgggtaaggagattgtgaaggagcgcgtggatttcgagccggaaaaacagcccggtgcggaagaaatcttaaatcagattgcggggcggatgtgcctgatgattcagcagtatgggaaggacactgtgctggctgcggggcttgcagtaccggggccttttattgcgaagaaaaaccgtattgcattgataacgggtgcggatatatggaaagatattgatttgaaagcattttttgacagggagatggatatcccggtgttcttagaacacaatgcaaatgccggagcctatgctcatatgtgggatttgaaggacgcctatcatgatgatattctggtttacattgctgctggtcaggggattggtgctggaatcgtgatgaatggcagaatctacgaaggaacgctggggacagcgggtgagattgggcatatgaccatagacagaaacggaaagccatgtgcctgcggaaacagaggctgcctggaacgctacgcttcttcgctggagcttgtaaaggcagtgtatggggagcgggccggtatggaaggctgtaattttgaggatttggagcagggaatcagaagcggcgatacagcctatacagagcattaccgcagagcatgcgagagccttggcgtgggaatcataaatattgtcaatgtgattaacccggaccggattattatcggtgacgatatggcacgcccaaacccggaattgatggagcagaccgtgcgggagacggtgcagaaagggattctgccggatgtctgggaagagcttaccctttccatcagcacataccagggggaccccatcttaaccggcggggctatcgtggcgattgacagggtctttgacagcccgggacagtttatatagaattgaatattggaattatgctgaaacagcattgaagtcatggaacgtttgcgcgagagatgactttgatgctgttttttttggctggccggttcagaaagtggaaataacctattgacattttcataaaagatgttattgtttaatagaatgtatttattaaatgaattaatacataaaatgaaaataatattaaggtgaatgaaaggggaagaaaaatgaaattttttattgacacagcaaaggtagaggatatcaaaaaggcaaatgatatggggattatctgcggggtaacaacgaacccgtcactgattgcaaaggaaggcagagattttgtggaagtgatccgtgagattacttctattgtagacggaccaatcagcggagaagtaaaagcgacaacgacagatgcccagggaatgattgaagaggggcgtgagattgcggcaatccatccaaacatggttgttaaaattcccatgacagtagaaggcttaaaagcggtgaaggttttgaacgcagagggaatcaaaaccaatgtgactctggttttcagtgcaaaccaggcgctgctggcagcacgggcaggtgccacttatgtatcaccgtttctgggacgtctcgatgatatctcccagccaggaatggacctaatcaggaccattgcagatatgttcaatatctcagggattgaaacggagattattgccgccagtgtgcggaaccccattcatgtaattgactgtgcgcttgcaggggcggatattgccacggttccgtacggcgtactggaacagatgacaaaacatccgctgactgatcaggggattgaaaaatttaaggcggattaccgtgctgtttttggagagtaagctgggaggagagagaagatggggaattatctggaattggaaaaatcggcaaatgaaatccgcaaagggatagtgaccgcagtacatagtgcaaaatccggtcatcccggcggctcgctgtcggcggcagacctgttcacctggctctatttccgggagatgaatattgacccggaacatccggcaaaagaagacagggaccggtttgtgctgtccaaaggccatgtggcaccggggtattattcaaccctggcaaaccgggggttttttccggtggaggacttaaagaccctgcgccataccggctcctacttacaggggcatccggacagaaagcatattccgggggtggatatgtccagcggctctttgggacagggaatctcagcagcggtggggatggcgctttctgcaaagctgagcaaagaaccataccgggtgtatacccttcttggagacggggagatagaagagggacaggtctgggaggcagcgatgtttgccggccatagaaaactggataatctggtggttatcgtcgataataatggacttcagattgatggttctattgatgaggtctgctctccatatcccattgacaaaaagtttgaggcgtttaatttccatgtcatcaatattgacggacatgattttgaacagatcgagcatgcatttgaggaagcaaggcagacaaaggggaggccaacagccatcatcgcgaaaaccataaaaggcaagggagtttcttttatggagggctctgtagcatggcatgggactgcgcctgatgacgggcagtatgaaattgcgatggcagatttggagaaagcaggtgaagcattatgcctgagataaaggaaattgctgtaaagaagattgccaccagggaaagctatggcaatgctctggtggaactggggaaggcaaatgataaaatcgttgtattggatgcggatctggcggcagcaacaaagaccggaatctttaaaaaggcatatccggagcgtcatgtggactgcgggattgcagagtgcaatatgatgggaattgctgccggtcttgctgccacgggcaagataccgtttgcaagcacctttgccatgtttgcggcaggcagggcgtttgagcaggtcaggaattccatcggttatccccacctgaatgtgaaaatcggggctacccatgcaggtatttctgtcggggaggatggagccacacatcagtgcaacgaggatattgccctgatgaggacaattccggggatggttgtgctctgcccgtcagatgacatagaggcaaaagcagcggtaaaggcagcggcggaatatgaaggaccggtatatatgcggtttggacgtctggcagttcctgtgatcaacgatacgccggattataggtttgaactgggaaagggtgttgtgctgcgtgaaggaacggatgtgacgttgattgccaccggccttgaagtgtgggaaacacttgcagcagcaaagcgtctggaatctgatgggatttctgcaagagtcatcaatatccatactatcaagccgctggacgaggaacttatctgcagggcagccagagagaccgggaagcttgttacggttgaagagcattcaactgtgggcggactgggaagtgcggtctgtgatgccgtgtgcaaagaatacccggttccggtgaagaaaataggaatccaggatgtgtttggtgagtccggaccggcaaaggaattattgcaaaagtatcagttggatgaaatgggaatataccggcaggtgctggaatttgtcagaggatataaaaaataaaaggggctgtttgaagttacgccaaaaggagattgaaagaatggaatttgaaaattcaattctgacactttttggtggttgaatgtttatattgaaacatctcgaatattgtagtaaactataaattgtggaaatcttgccttccgcaagaatcaccaatggttttatgaagcccaaaaccattactgcgacgtactgaacgcacatacagccagctttattcaacatctgccaaactatttgcaaaaagctttggaatatgtacaaaccgttttttgaatgctgctttgtgagctaaagtattgatcttttaaggaacaattcccgtttttagtgtaggaaggttgagtttttatttaaaaaagtggtataacctttgaaatataaggttttaaataaaaatagggctatgtaactttacagtacattgaaacatgagggggtgtaaatatggatcttcaatcattattgtattttaaaaaaattgcggaattggaacatttcactaaggctgctaatgaacttcatattgcgcagccttcattgagccggacaatcaataatttagaaaatgaattgggtgtggcggtttttgatcgagtaggcaagtacattaagctaaatacatatggcaaaatactgttagaacgaacaaacagggtctttaaggagcttgacggtattactacagatattgaggagagtaaaaaagattttgacaccacagtcattatttctctgtcatcggcatcaaaaatacttcctgaaattataatggaatttaacaaaatttacccaacgactaaatttaaaattttgcatggggattataaaacagcatcaaatgccgcccatgatttatttttatactctactgctcatccgatcttcgatcatccttgcgcatgttcgttgtttagagaagaaattttagttgccctgcctaaaagcaatcccttatcagatcaagaagcaataaatttacatgatttatctgaattggattttatctgcttgcaaaaaggcaaaagtatccgtacgataactgacttttattgtgaaatggtgaactttaagcccaaaattattctggaaagtaatagtccggaaacggtaaaaaattttattgaaaaagggctgggagtatcctttaccccttctattacttggggcaaagtattgggcggtgataatatttctttgcttcctgttgcatttcccaggtgttacagctatttaaatttgacgtggcgagaggatgattacttgtcttcgtccgctaagaacttcagggactatttgatccgctattttgaaacttccgacaactatgaaccgtgcttttagctaatgcaaacatacatattttgccaatgataacaaatttattataaatttatgataaattaagtattggaaacaaagaaagttttgtgctaaattaagtatagtacaaaactttctttgttttttgcatttaaagctttgtgattactgactataagttgccgaaaggcggaagggactggctttgtatatcaatgaaaagactaccttattttatcaatggagagtttaaagaatcaaaaacaacaaaatatttggatgcgtttgacccgagtacgggagaggtgattgcacaagttccgacttgtacagcacaggaggttgaagaagcaatagctgcggcaaaagcggcctatcccggttggtccggtacaccggttatcaagagagtgcaaattttatataaattacgtgacttactgattgagcacatggatgaattgacgcatctcttggctacagaaaatggaaagacatgggatgaagcaaaaggagatgttttaaaggcaaaagaaggtacggaacaagcaatcgcagcgccgtctcttatgatgggtgaaagccttatggatgcgtcctccggatatgacactgtattatacagggagccgttgggtgtatttgcgggaatcgttcctttcaactttccggcaatgattcctatgggatggatgacacctatgtgtatcgcttgcggtaacacaatcgtattaaaagcggctacatttacaccgcagacgtgtatgaggattgctgaattatataaagaggccggattacctgacggagtgcttaatattgtaacttgttcaagaaatgaagcagaaatcttattaaaacatgaagacatcaaaggtatcagtttcgtcggttctacaagcgtggggatgcatatttattccacggcagcagctcacggaaaaagagtgcaggctttgtgcgaagcgaagaatcatgctttagttttaagggatgcgcctattaagaggacggccgcaggcatcatcaatgcatcatttggctgtgccggagagagatgtatggcattgcctgtagtggttgtggaagaagcaattgcggatgaactggttgcagaaattgtgaatttggcctctaaaataaaagtgggtcctgcgtatgataaagaatcaaaaatgggccctgtagtcaatgagtctcatatgaaatccgtactttcctggatagaaaaaggtttggaagaaggtgctacgcttgcgttagacggaagaggtgtgaaggtggaaggtttcgggaacggattctatatcgggccaactattttagaccacatcaaaccggatatgacaattggagacaacgaaatatttggtcccgtactttgtatcaaacgtgtgaaaaactttgatgaaggtttggcgcttatgaatcacaatgaatttgcaaacggctctgttatatttacgcaaaacggatattatgcaagagaatttgcaagatacacagatggcggcatggttggtgtgaatgttggtattcccgtcccagtaggtgcattcccattctcgggacataagaaatcttttataggcgatttacactgccttggaaaagacggctaccgtttctatacagagacgaaagtagtaacgagtcattggtttgatgaaggtgagatccatcagaccgaagtgtcaacatgggatggtacaatataaggatagtcgcaacataaaccgattataatgataagtcttaaataggctaggagtaaaattatgaataaaatgagtattcctgatcttgaagctacggctattgatatcagacgtcacatattaaagacaatttttaatgcaggatgcggtcataccggaggctctttatccgaagccgatattctgactgccttattttttcgtataatgaatatagatacaagcaatccgagaatggaaaacagagatcgttttatcctttccaaaggacactcaacacccggatattattgtacattggctaagagaggtttctttccattggaagtgcttttgacttttgatcaagaaggaactattctccaaggacatccggatatgcacaaaacaccgggggttgatatttcatccggatctttaggtcaaggcttatccttaggtataggtatgtgtaccggcagagatgcaaaaaatttagatttttatgtatatacactccttggcgatggagaatctcaagaaggtcaagtgtgggaagctgctatgtatgcaggggcaaataaaacaaaaggtctgattggtattaccgattataacggtgttcaattatcgggagaagtaaataaaactctctcactgggttccttaaagaaaaaatgggaagcatttgactggactgttttagaatgtgacggacactctatgacagagcttgtatcaacacttgaacatgctaaaaacttatcaaatgaaggacctgttatgattttagcaaagactgtcaaaggtaaaggcgtttcatttatggaaaatgattaccattggcatggcaaggctcctaataaagaggaatatgccttggctatgaaagaattggagagataagtatgaataatatggttgcaccaagagtggcttttggaaaagctttagtagacctcgctgatgaatatcctatgcttcatgtattagatgcggatgtatgtccttcaacacaaacacatctttttagagaacaatatccacaaagatttatccaatgtggaattgcggaggcaaatatggttggaatggcagccggaatggcgtctgttggctgtatcccttttgtttctgcttttgctgtctttttagcaaaacgtgcggctgatcaaattcgtgtttcggttgcatatacaaaattaaacgttaaaattaatgctgcttatgtcggccttccgacgggcagagccggagcgacacactcatctgtagctgatatggcacttatgagagccatgccaaatatgacaatattaaatccaagtgatgcgattgaaactgcagctgctgtccgcttagcacttgaaacaccgggaccggtctatttaagaactgtcagatgtcctgttcctactatctttccggagtcttataagatggaattaggaaaaggtgttgagctcatggatggaaaggatgctgcaattatttcaaccgggatgatgagtccaaaagcattagaagccggtaagctgctgcggaaaaaaggaattaatgttcgtgtgattcatatgggaacaataaaaccgttggatgaagaaataattattaaagcagccagagaatgcggaagaattataactgttgaaaatcatagcagaattggcggtcttggcggtgctgttgcggaagtattaacagaaaaacattgttgtcctctgcttagaattggttttccggatatttttcttgagtcaggtgatgatgaagccatatttagtaaactgaaaatgaatgttcaggatattgcagacagaacagaagaattaattaaaaataccgattaaaactatcaagaataataaggaggtatttatgcgtatcgcagtaatcaatgaagtaagcgctcaacaaaaaaacagtgatattattaaggcattagaaggccggggacatgaagttttaaatttaggtatgaccggaaatccagaattgccggaactgacatatatacatacagggttaatgacagcgatgttattaaactctgactcagttgattttgttgttggaggctgtgggacaggacaaggatatttaaatgctgcgatgcagtatccgggagtattttgcggactgatttctacttctttagacgcctggctgttcacacaaatcaatggaggaaattgtatttctttacccttaaatcaaggttatggctgggcggcagatgtaaatcttcgttttatctttgatcggattttcagcgttgaaagtggatgcggctatcctgaaaccagaaaagaatcacagcaaaagtcaagacagactctttcacgtatttctcaaattgcccatagaccttttcttgaaatacttgatgatatgccatatgaaattgtaaaagcagttgcctgtttccctggttttatcagtgtcttagataaaaaaacacaaactctattacaaaaatatattgaggattaatgaggtttaagtatgaatgaaataattgaacaaagaagaaaacgtgcgaaagagattaaaacttatggcaccttacaaaaagctgtagaagcaggcagcttaaaacaatttcaggatatcagtctcagtgaagctgttgttttaggcttattaaatcaaggtgtcagaacttttataggtatttttggtcatggaatgacagatgtaggagaaatactgcgtatatacgaagaagaaaatgctatcaggacagtaaatgtccgcaatgaagtagaagcatctcatgtggcatcgatgcttcgatggaagtataatgaagtttcggcagtttttacttctattggaccaggagcgttacaagcagtagccggatccttagtttcattgtccaatggccttggcgtatattatcttatgggagatgaaacaagtcatagtgaaggaccgaatatgcagcaaatcccgaaaagagaacaagagctttttcttcgtcttttttcaacactaggatctgcatattcattacataccccggaagctgtttttacagctttaaaaagaggtgatgctaccgtcaatgggggtgtaaaacaatcaccgttttatatgttgcttccaatgaatattcaaccaaaattgatgaaagactgcaatttgcttgagtttcctcaaagatcacaggagtcaaaaatcataagtacagatttaaatctttttaatgacgcactggagtctatctgtaattcaaccagaatcacagttaaaaccggaggcggagctgcaaatgtatctcctgaagtattagaggaatttttagacctcatcgatgccgcatatgtacatggccctcaggtcccgggcttatatccatattcaaaattgcgcaatatgggtgttggcggttctaaaggatcaatttgcggaaattatgctatgaatgaatgtgacttaatgattgtcattggagcaagaggcgtttgtcaatgggatagttccggaactgcttatcgaaaggcaaggaaaatcattaatattaattgtgattatgatgacttgggtcagtataacaatagtgtgcgtttacaaggagatgcacaggaagttatcctgaaattaatagatctggtaaaaaatgccaaaagtaaatcatctgaccctgagtggttaaaagagtgcataaataaacggaacgagtgggattcttttaaacaattaagatatgataatcctgttttagaagatgaaaaatggaaaaaaactattctaacagaaccggctgcaataaaaaaagcagtagattttgctgatgtgtatggatgcattaaaatatttgatgcaggtgatgttcaggcaaatggtttccaaattgtgactgatgaaaaacccggacaaacgataacagaaaccggtgcatcttatatgggttttgcagtttcttccatgcttgcttttgcattgtccgggaagaatgaatatcctatggcctttacaggtgacggcagctttatgatgaatcctcaaattttaattgatgcagttcaacataaattaaaaggtatgattgtcctgtttgataaccgccgtatgggcgctatcaccagtcttcaatactctcagtatgacaaagaatataaaaccgatgatgcagtggttgttgactacgtacaaatggcagagtctgtaaaaggtgtgaaaggtttctatggcggagaaaccatagaagaattagaaaaagctttaaagcaggcatatgagtatgatggactgtccctgatccatgttcctgtatattacggaagtgatgaattgtccggtcttggtgctttcggagattggaatgttggcaattggtgcgaaagggttcagaaactgaagcatgaaattggcttttaaaacaacatagtagatccgtttaaattattagtagcagatgcaaattgctacaggtaaaatataacattaaaaaggagatatttttatgaagtatgaaatccccgagaagatgaaagcgtgggttttgggaaaccccggtgagcttacactaacagaaaaaacagttccgcaacccggaaaagcagaagtacttgtaagagttgatgcagtagcgatctgtgcaactgacttagagattatcgaacgtggttcacctgctttgattcaaggtggtttacctttcaataaagggtttacaccgggtcatgaatacatgggtactatcgtaaagttaggacaaggcgttgatgagtataaagtcggtgatagagtagccgtggagattcatgccggatgcggaagatgtgaacgttgccgtgaaggtatgtatacctcctgcttaaactatggcaaaaattacgaaggaaatgacaaaggtcacagagctaacggctttacaacagacggcgcctttgctgaatatgctattaacaatgttaatactttatgtcatgtcggagacaatgttacagatgaagaagcaacactgattgtaacagccggaaccgctatgtatggcttagatgcacttggcggtttatttgcaggtcagtcgctggttgtaacaggtccgggtcctatcggtttaatgggagtagcggttgctaaaactttaggcgcgagtccggttattttgacgggtacaagagatagcagacttgaacttggaaaaaaacttggtgcagattatacggtaaatgtcagaaatgaagatgtagttgaagcagttaaaacgattacgaacggtgaaggtgttcactatgtactggaatgctctggagctgcaagtgctatcaatgatgctgccaagatgctcaaaagaggtggaaaaatctgtttagccgctttcccgtcaaagcctgttgaagttgatgtcgcagctttagttcgcaataatatttctatgtttggtattagaggtgaaggtaagagtgctgttcacagagctgcttcattaatcagtgaaaaatattttgatgcttctctaatccatactcatacatttggttttaatgatttgcttacagcgctgaaatattcaaaagaaagaattgatgacgctatcaaagttgttgtgaagataccgggataggagaaaaagttgcatgcttcaatacaaagactattatatgcccaaatcaaaggaagaacttttcagtataattgaaagtaatgatgattcttttgatattatttccggaggaacagacctttttgcaaaagaaaaaaatgtttttagtaatcccaaatttgctgtcgatataagcagcattggagatttttctattatagaatccagagatgattttataacatttggttctaataccaggattcaacagtttttagaagatcccaggttgactgaccatgtgcctttgatgaagcatgcagctatctggtttgctgaacagcaaatacgagaaatggcaaccgttggaggaaacctagccaatgcatctcctaccggagatatgcttccgcctttattagcgatggatgcaatcattcatactattatgaagaatgagcaaggcatctgcaaaagagatataccaatcgctgattttattaagggagttggtaaaaccgcattatttaaaggtgaaattatccactcagtttcatgtcctatattaaaagattatggatgtgcatttaaaaaagtagggcttaggcgttctttatgcatttctgctgtgaattctgcttttttagtaaaagctgataaaacaggtagatattttgaagatgtgagaattgcgtttggaggagttggtccgcttcctgcaaggttaaaagagattgaagacaatttaaaaggtaaccttatttcaaaggaaattattcatgaaattgttaaatatattccatctgatattgttcagtctcgaagcagaagagagtatagaaaaacggttattagaaattttttgccagatggtctttatgaatcacttgctgaaattaatattgtactgaaataaaaaagtaaatgtaaattgcaatatttcagccgttttagagcttgtatctgccctcgttccgtaaaagttaagtgctcctcacttgcgttctacgttttttatatataattgggtgcgcccacagtaattttccttcggcagatgttgtgtcgtaactctatactaccatcatggaaaattactgtggatttttttatttggttgtctatttcgattttacaatcaatcatttgaaattaaatataattttcaaatgataaagagaggaggattatgaattcacaacttgaaaagattgaaatgaaagtaaatggaagaaaagtttgtaaatatgttgctccgtccatgagacttgcagattttttaagagaagaatttcatttaatcgggacaaaaaaaggttgcaatgcaggagaatgcggaacatgttccgttttacttgatggagtactaaaaaaaagctgcctgataccggttatcaaagctaataactgtgaaattctaaccatagaaggcattggtctcgaaggattaagcattattcaaaagtctttcatgaaagttggagctgttcaatgtggttattgtactccgggtatgatcatggcagcaacatctttattaaaaaagaataaaaatccggatagaaatgaaatcagaagaagccttagtggaaatatttgcagatgtacaggttatgctaaaataatggatgctatagaattggccagggatatattaaataatgaaaaaagcgtcgattgtttagaaccaattgttactgataccgacaagataatcggctcttgtacagaaagagttgatgcgaaaggtaaagttacaggtgctcttgaatatgcagctgatatgaagatgcccagaatgcttcatatacatcttgtcagaagcaaagaagttcatgctgatattttaagtattgattacgaaaaggcattaaaaatgcccggtattgaagctgttattaccagtgaggatgtaccaggggaggatggattcggagtttactatcatgatcaacctgttttggcaaagagtaaaattcgtttttatggcgaaccggttgcagctattgttgcagaaactttagaagaagctgaagaagctgaaaaactaattgaaattgtatatagtaaacttcccatagtttccggcattgaagaggcgattaattgtaaatcagtaattcataatgatcatcccaataacatggttagcacaacatctgttataaaaggagatgttgaaagcggttttagcaatagtgatataattatagaacaagattattcaactcaatgtgttgatcatgcctatcttgaaacggaagcaggccttgcatatttagatcccgatggtgtattggttgtaaaatcatgtgatcaggatattacgcagcaccgtatgcttttagcaaagattttaaatatgcctataagcaaaatcagggttattatgacacctgtaggcggaggttttggcgggaaagaagacatgatttatcaaggaattcttgctcttgccgcacttaaaacaaagcgtcctgtgaagttggtcttttccagaaaagattccatgattggcagtgcgaaacgccatcctgtattaattcatcataaaattggattaaaaaagaatggcaaaatacaagctatagaaattgaaataaaagcagatggaggagcatattgcttttcaacgaaaggaactgtcgcaaaagcggccatgttaggggcaggcccttatgaaattgatcatgtaaaggttatttctaaaggctattatacaaacaatactccttccggtgcgatgagaacttttggagtattgcagccaacttttgcaattgaatccaccattgatatttgttcacagcgtttggaaattgatcctattgaacttcgcttattaaacggattaaaggatggaagttcaacgcatactcaacaagtattaggcagggtaggttatacacaaacattaaaaaaatgtgctcaaatggctaaatgggaatcaggtccttccaatataagaggccaagtgagaaaagatttaaaaggtgatcaagtcgcagaaccctttataccgggaagtgagtttaaatctccggctgcacttgaactttgtaaatcaaggtttaaatatggccgtggtgtcggaacttcatggtatgcaataggacgttctgcaactgctgatagagccagtgcatttgtcgaaattgatgatggcggtactgctaaagttttaaccggtgttaccgagattggcgaaggtattctgacagttttaacacagattgcagcagatgaacttggaatgtatcctgatgatattatcattggggacaatgatacagcaagagctcctgaagcagctcatgccggagcaagcagacaaacctatatgattggtaatgcagttttaaacgcctgcagagatgtaaaaggaaaattcatcagagagattgccgcatattggaatgttaattcaacctctatatgtatgaaaaacagaagaatttttgtaccagggcattccaattataatctttcacttaaagaggctgtagatatttgtaaaaaggttagaggtatcgttcctttaggttcaggcacatttacagctcatcatgaagccatagaccctgtaaatggtaaaggtaagccttggcaggcatatgtgtttggaactcagattgcagaggttgctgttgattcatctacaggagaggttcatgttcttggtatttgggcttctcatgatgttggaagagcaataaatcctcaaggcattgaagggcaaattgaaggaggtgctgttcaaagtattgggcaagccataatggaaaactttgaattatcggaaggcatacctgtaaataaggattttgcaaagtatattctgcctaccagtgtggatgttccaatgtttcactccagcatagtggaagagatagatccttttggcccccttggagcaaaaggaattggagaaccggctccactaccaactataccggcaattattaatgcaatttatgatgctgttggagtgcgtataacttcacttccggctaacccggaaaagctattaaacgaaatgtcaaagcaataatcagttagtatttaaatttttaggggtgtattatcaaatcgtattggtaagtcaaggtgcacaaaaatcagggatgaataactttatctattcctattttgattgcaacaaggaccgatatatgggcaagtaaacaactttcatttttttgtatattgtgaagaaaaacgtaaaaaaaggagataggtaatgaaaaaaatggaaaccgtacccggtaaatcaaatggtttatctttagatttaaaaagatggatttatataggtattagtattattgtgttgatgtttattatgaatattagcttgccggcatcttttacagatataaaggatgcaccgttaacagctgaaggacaaaaagcactggctattttagttttctctctcatactttggataacagaagcaataccttttcactttacaggtttactgtcaatggtattattagcattggctggaattgattccttttctaatattgttcaaataggttttggaaataacactgttgtgttttttataggtgtgtttatcctcagtgcatttatcaataaatcaggacttggaaaaagaattgttatcagttgtctttcaataaccggaaataatacaaaatacgttttattaggctttataacagtaggtgctttattatcaatgtggatttcaaatatggctgttgctgctatgcttatgcccttggccaaagctcttttagatgatgaaggggtaaagccaatggaaagtaactttggtaaagctcttctcatttctgttgcatggggtagcttaataggaggctttggaactcctgcaggaaatggcccaaatccattagcaattggttttatgaaagatatggcgggaattgaaatgacattcttagattggatgatatatggagttccaatttcattaatacatattcctgttgcatggggtctacttttattagtatttaaacctgaaattaagtatcttaaaaaaacaaatgaagaaattaaaagagaagcaaaaaatcaacctaagttcagtcgtgatgaaaaagtaaccctaattgtttttgttattacagttttactttggctattttcccctcaagtatcagcattattaggcgtttcaattccaatttcattgccggttatttttaccacaatgctttttttcttcccgggtgttagtaaaacaaaatacaaagaaattgaaaaagaaatttcctggagtagtatcatattagttctttccggtatatcacttggtatgatactttataacactggagttgcaaactggatcgctcttggtttattaggaagcataggtgaatttggcgcctttatgatgatttttattgttgtattaagtatatcgtttatgaatattgctctttcaagtgctacagtatctgcaagtattgttattccaattgttatacagctttctatgactattggagttcctacattatctattgcattccctgcagcattagcaacttctcaagcatttattttaattacttctactccaacaaacgtaattgcatattcggccggttatttttcaatcaaagattttgcaaaaataggagtaattatgtctattgcttcttgtgtaatagtagctttaagcatgcttggtattggattaatgacaggattatactaatgttttgatgatatttagcatggaactgtcggttgatgcttaattttaaccatttcaaatcaaataggagcatcctcaccggaatcaatgctttaacagcattgtactttcaggtggggatgtttttttaccttcagttggtccgatgatcagtctgttaaattatgaattttaatatattttgctgtaataaataaaaaattaacaaatttgatgcaaatgtttcaagcattgcaagggaaatgttgaaaataatgcaaaaataaggtataattagtcaaaattcaaaaggaggaaagtctatgtataatattctgattggtggcgctgccgggcagggcattgacacaacggttgcaattctggaaaagctgctgaagcattccggctattatatctataccaccagagatttcatgtcccgcgtgcgcggcgggcacaatttttccctgcttcgtttcgggacagaggaaataacctcacacagcgatgttttagatgggatcgttgccttaaatgaggaaaccattgatttgcataagcataagctgacggccaaaggatttatattatgtgacagcagctttgcttatccggatggggattccagggtcattaagcttcccatgaataaaactgcgaaagaactggggaatgtgaaggcctccggcagcgtgggagtgggcgcggtattgaagctctttggcgagccatttacatatgcggttgacgtcatggcaggtgtcatgaagaaagagatccttgatgtcaatgtaaaagcggctgaagcaggatacacggctgttgaagcgaaatttaagcatctggatggaggatataaagattatatgctcatttcaggcagcaaggccctgggacttggagcggtggccggagggcttaagttttattccgcttaccctatgtctccttccacggctgttttggaatatctggcttccgtgggtcatgaggcggggatcgtggtggagcaggcggaagatgagatcgctgcagtcaatatggcattgggtgcttcctatgcaggagcaagggccatgaccgggaccagcggaggcggcttctgcttaaaggtggaagcgctgggattttccggcattgcggagattccgctggtggccgttgatgtgcagaggcccggcccggcgaccggtctccccacaagaacagagcaaagcgatttaaaattcgttatttctgcatcacagggggaatttcccaggctggtcatagctttgagaaatcatgaggatgctttttatcagaccttccgggcgctgaacttagcggagaaataccagcttcctgtcatactgctcagtgaccagtatcttggagatacaacagcctgcgtaaagccctttgatacctccggcttggaactgatcagtcatgccagagaagcggaaggggagtatctgcgttacaggataacggaagacggcatctctcccaggcttattccggggctgaccagccatcttgtggccgctgacagtgatgagcatgatgaaagaggctggataacggaatcagcggaagtcaggaatcaaatggtggataagaggatgagaaaattaaagggccttatccaggaattgttggagccggagtttatgggagaagagcagtgcgaaacccttctcctgggctggggttctacctatggtcccatcagggaagccgtatccttgttaaataaaaatgggaatggaagctatggcgctttggtgtttggagatatttatccccttcctcaggaaaaactgaaaacctatgcaaagaacaggactttaatcaacgtggaacagaatgccacaggccagctggcctccctcataagggagcagacaggcatagaatgccataaaagcattttgaaatatgacggcagacagatatccggagaagaaattgcaaagcatgtgttggaaggaggttccaagtagatggataaattcacaacttatgaaacagcctggtgtccggggtgcggaaatttctccatattaaacagcctgaaaacggcgttggaggagctgggcataaaaccaaatgaagtgctgatggtggcaggaatcggtcaggcagcaaaaacacctcagtatttaagtgccaacagcttctgcgggcttcacggaagggccctcccggctgcagttgctgccaaaatagccaatgaaaagctcactgtcatagtaaattccggagatggggactcttatggcgaaggcggcaaccactttattcacaacataagaaggaatgtcaatattgcacattttgttcatgacaatcagatatacggactgaccaaggggcaggcatcacccaccagcggtgaaggactcattacgggagttcagaccgacggcaacagaaatacgcccttaaatccggtactcctggccattgcttcgggagcgggatttgttgcgagaggcttcagcggtgattcaaagcagctggtaagcatcatgaaggaggccatcctttatccagggtatgcgtttgtggatatcctgcagccctgcatcagcttcaacaaaatcaatacctttgcctattataaaaaaatggcggcgcctcttggtgacgattatgacccgacggatcggctggaagccattaaaatgtcaatggaagtcagcgaaaaaatccccaccggtatcctataccgggaagaaaaaacggagtttcaccgaaaaaacaggcttttaaaagacggactgccactgttagaacaaaaaacagaggaaagcgtactcaagaatctgattcacagttttatataattatataaaatcagctgctgcaatgaagctgatggttttgcaggaaggtatttgaatccatctgatatcgtcagaggttatcagatagaagtatttataaaagtctgaattctccagttgagatggtctttaatgaaaaatagtactttcgtaaaagaatggaatgtggtagaatgatcccagctaaaacccggaatattgagacagttagtttattatcccgcatataattaggattaacaaaaaatttagaattgctgcaagcaggcggtgacaaccattgacaactatttttgatgatgtcaaatggaggccgccttttcaaatatatccagactgagggaaggagcaaacgagcagagcggcaggatggtgtaccaccaggatcaaccatcattccggcggaaaattgcaactttagaggagagcagagttgaagaactgctggaaaaaatgaataaagacgatattgataaaattttagagaagtatactgaggtatgggaggataatggatgtatattgttgcttatcgtttgttgaatttactgaatgattgtgagtttggttctacagatgcacatatcgcgaaacgtttgctggatatgatatacgaggttgagtttttgccgattgaccaggttgcggcaaaatgccacatttccaagtccacactttctaaattcataaagcgccttggttttgaagattacaaagagtttagggataatgtcaggaatgagaaaaagagaagcatatatactggaaatgaacaaaagttgtcgatgaaccagtttatagaagcaaaaggaattgaacaatatttaaaaatcctttctggtgatattaagaattttctgtccggaattaatatggagcagattcaaaaactggcagaggctctttacgaatatgaaaaggttgctgcattcggagccgtttattcggaaacggttgctatggattttatgtatatgattgcagaggagaggaaatatataaaaacgaatctctttgatataaagcaggaacaatttattaatcaggcagacgagaatactctgattattatattttctaattccggacagtatatttacagggatgggctgaaagctttaaattcatctaaattatttataaaaaaaactaagggacggatagcgttgattacttccaacaaagaggccgcgtatgacccttgtatcacgtatccggtcttatatcatttaacaacagatgtgcagaatcatctgattattgaacgtgtagttgtggatctgatcgtagacgtgtacagaaaaatcagaaaagagaaagaaagataagctgagaaaagacagactttcatgtgagagtctgtttttttgttagaaatagctaaattttgttcggataaatgaggtgaaatagctaaaaaagtttccaaaaagcgaaatttaaagatttttaaagtgattatatttataataaacaccaggttattatgcattataaattgattaaatcagccatgaaaggagtaaaagatgttagagggttattaaaagccgtagaattatggggagcctgttggttttttaaagaatgtttcggtctatatattttattttgttttccattgcggcaggttttgccagcacaaagaccggaagttttgttcctgttacaaagtttattttgagaggagattcgttttttattgaaagagtcgtgatgtgttgagtgaaaacgttaggaggaagggctatgtattatattattgcttcacatggcgaatatgctgaggcttgtaaaaagagctgtgaaatgatctctggagcagcacctcagtttacagttgtgacttttacagaagaaatgacaaaagaatcggttgagaatgcttacagaaagattcttgtggaaaaaggatcagaacagtgccaggcaattattaccgacataaaaggagggacgccttataacgcagcaattaccataagacatgagtatccatctgttgcgctggtatcaggactatgtctgggtatgctgattgcattgagtataggtgatacgctggagagtgcaatggaacagtcaaaagaaataattaccggagaaggggtatctgcggaaaaaaagacaaagaaagttgctgaatctgctgagccggtggaaaataacggtattgtgaatttcaggctggatgaacgtctgattcacggccaggtggcaaccttttggacacgtacccttggtgtcacaagaattatgatagtggacaacgatatcttaagcgatgagatcagcaaaagggctctgcaggcagcagttccgtcaggtatcaggctaagtgtcctgtcagtagcttctgcggcgaggaagctgaacaaaggtgcatacacaggacagagagtattcctcattgtgagaaagacggaaacaatccatgaactgcttgaagcagggatcaaagtaaaggaagtaaacattgggaacatgggagtgaaagacggacggaaacaaattacaaaatcaatatattgcacgaaagaagaaattaaggatattctggatattgagaaatccggcgtacaagtctatgctcagatggttcccaatgacgataagaaaaaattcacgtctttcataaatgaagtgaggaggtattgagaatggaaattcaagtgtggcagattatagtattgacattgttagcattcttttttatttgtgaaggcttatctacatctatatttgcaaatcagccggttataattgggacgatcaccggtattgtcatgggtgacatgggaacaggactggcagtaggggctactcttcagttaatgatccttggggtaggaacatatggcggcgcttccatacctgattatgtaactggtgcgatgattgggaccgtatttgcaatcacgtcaggaaagggaatggagtttggtatgggacttgcggtgcctgtagggctcttaatggtgcagctggacgtccttgcaagattttccaatgtgttcttttccaagagagtggaggcagcaatagaaaggatggactttaaaggaatcgcaaagaatacatggctgggagctctttcgtgggggctttccagagccattccggtattcctgatgctgattttcgggcagaatcttgtaaataccattacagggcatatgccggaatggctgatgaacggtctgtcagtagccggagggctgcttcctgcagtgggcatagcaatcctgctaagatatctacctgtcaaagactatattgcttatctgctcatcggtttcattgcagcagcttatttgaatgtgccaatggttggagtggcaatcatgggagtggcattggcaatcatcgcatttaaacaagaggcagcgaaaagccagaacattgttgcagtaaatcagggtgttgttcaggagggattgttagatggagaatacgaagactaatcaggaaaagattacaagccgggatataaacagagtaagcaaaagatggattatggcatcacagattacatggaactatgaaaagatgatggcaataggttacctttattccatacttcctgttttgcgtaaattatataaaaaagaggatgacttaagaacagcaatgaggaatcatgtgcagttttttaacacaactccacatatgggcggatttatactgggcattgatgctgcaacagaggcagagggaaaaaacagcagttcagatggggttgaaacagcaagtggtattaagacaggtctgatggggccttttgccggtgttggtgataccatatttggagtcctgataccgacgatttgcggttctatagctgcttatatggggcagcaggggaatgtgacaggtgttgttatctggatattggttaacattgcaattatggcgttccgttatttcacagtaggaattggctacagagaaggaacaaaattaattgcctctgcaaaaaacaagctggatgcattgacaagtgcggcaacactgcttggaattaccgtggtgggtgctttgattccaactgtagtcagagcagatgtaacagcaacttttacatctggagatgtgactttggcaggacaggacattttagatcagattatgccaagccttgttccggttctggttgtagcaacaatctatattttacttggaaagaaaaagatgacttctacgaaggcaatcttgattgttatggcagcatccatcatttttgctgcaattggatttttaggataaacagacggtataccgttcccggcagacggcagggatgttctgtggtgcggtagaaaattaaataatacagtaaggagagatattatgggaatggagtattttaacaaatcaagaaaaattatggaccaactggaggcatctgaacagaagcacattcatgaggcggccattctggtttcagattctatcagaaacggaggaattctgcaggcatttggaagcgggcattcctatgcaggtgcaattgaagtatgcggaagagccggaggtttgattccaagcaagcttatccgtgacaaggcagaaggaatgtatgagagtgtggaaggaaatgcaccgtttttaatgcgccaggtgaacataggagagaatgatattttcatactcatatcgaactccggcagaaacccgtttgcaatagaaatggctgattacataaagaaaaaaggcaataagctgattgtggtaactgcactggaggtatcgaaaggttcaacttccagacattcttccggtaagcttttatatgagttcgcagatgtggttctggataaccattccgcatttggggatgccgccttggaagttgaagggctggattacaaagtctgcggaacttcttcattcagtacgtgccttctgctgcagcaaatgatttatgaagcaatacaggatatgatgtctaaagggtatgagcctccggtttataagagcgctaatattgacggaggaagagagttcaatcatgctattgaacagaaatatgcagataaaatctggcatatttaaaacaaagaaggaagaagtgatggagaattccaaaatcactttaaggctttgatccgcttgatttaaaagatgcagtacagggaaaagcggttccgtaaagaggaagaggtaattatgaaacattcagtattagaagtatgtgcagattgtgtgcagtctgcaataaatgcggataaagcaggagccgacaggattgaactttgcagcaatctggtaataggcggtgtgactccgggaaaggcattgtttaagctggtaagaaaatatacggaagtaaaaatccgtgtccttctgcgtcccaggtacggtgattactgctataatgattatgaatttgaacaattaaaagaggaagtacagatgtatcatgaattgggagccgacggtgtggtaatcggaatcttaaggccagacggacagctggatgaggaaagaatgttcgaactgatcaaaatagccggaaacatggacactgcactgcacagagcatttgatgcctgcgtaaatccaatggaagctatggaacaggcagtttctttagaaatgaaaaccattttgactggcggacagagtgggaatgcgtggaatggcagagaactgttaaaagagcttaatgagaaaagtgcaggaagaattgagatcctggcagcaggagggattaatgctgaattaatcgaaaaattaattccacttaccggaatcgcctcttatcatatgtctggaaaagctgtggtggaaagcagcatgacatatcgaaaagcaggagtaagcatggggcttcctgaaagagatgaatacgccctttggcagacatcaaaagaaaaagtaatacaggctgtacaagttttaaaaaatgttcagaataaataaagtggtgtaaatataattccaacaaaaaattcttcaaaatataacttatttccaaggggaaacagatactgtggtcatcaaggttttaaatacaaggaattgtgagatgcttgtggaattatatagaaaatagatgatggacctatgaggcgtgaacagttatgttcacgtctttattatatctgtcattctatatttctgaatattgttatggaaaaacagatttggaaatgatggtaccgggtttatgtaaaagtaaagctgagaatttaatatgtttactgcattaagatagtctggctataacatcatacatggcttgcctccttacaaaagagggaagcagactggactaaagcttgcttatttgttatagatcttgaaataatatatataatccataaaataacaaaaactattatttttcagataaataatatgatataatgtggatagtgctattgactactataggaggagataaaaaatcagttttcaacaaaattcttgtgaatgggttggattaaagttccggaaatatacaatgatatattaaggtcataactttgaatttagataaggaataagggtgaccaatggagcataacaactatcccctaactaaaacagtacaagaataaaacatgctctattccgggaatcatcctggtatgctttgcagttgtatacagttctgctgtcagaatttaaaacagatttgaagattagcaggtatcaagccgttgcagataaaatccacagaggagagataaagaaaaacattgcctattctgtaggtggcgaagcttgacatgaagcagctgtaaggtcatgcctggtgaagcggattgcatgtatccgattgactaaacgtaccaaaagcaggcaaaaatatttcacaggcggttgagaggctggaaggctcgtaatggattacttgactgccaataaagatgaggtgctgaaatgactaactggaaacgtaacgcaacattatatatcattgggcagttcgtgtcaatgttcggctcaatgctcgtgcaacacgccataacctggcagatcacacttgaaaccaaatcaggagtgattatgacgctgttcacctgcgctgcgctattgcctatgacgctgatttcgccgtttgcgggcgtatgggcggacaggcacaatcgcaaacaccttatcgtaatatccgatgggtgtatcgcgctgataacgctgggtttggcggccgcgtacatctccggcaacaaaaatatctggcttatgttcatagttgtagttgcacgggcatttggacaaggcatacagcagcctgccgtatccgcaatgataccgcaaattgtgccgacggagagtttgcagcgattcaacggcattcaaagctcaatccagtcgctgaatatgtttgtcgcaccgatggcagcaggggcattgctgtcgttcttaccgattgaatacattttcttcattgatgtggtgactgcggccataggaattagcatagttttgatatttgttaaggtgtccggcgttccgcacgccgagaaagtaaagcctggtgtaaaggcatactttcacgaactgcgtgaggggctgcggtatatcaactccaaggcgtggctgaagcttattatcatttacagcgcgttcttcagctttttcgcgtcgccctctgctttgcttactcctcttcaggccgcccgtacattcggggatgatgtttggaggctgactgcgattgaaattgcattttcccttggcgcggtcgtaggcggcatattgatttctgtgtggggcggtttcaaaaataaggcccacacgattgtcatggcttgcgctctattcggtttgacaggttttctgctcggtgtagtgccggatttttgggtatatttaggcgtaatgctcgcctgcggcgttactatgccgttgtttaacacgcccagtatgacgctgctccagagtaaaatagagccggacaaaatggggcgcgtattcagcgttatgatgatgttcagcgggttggcaatgccgctcggaatggttgtgttcggacccttgggtgatgtggtgcggattgagtggctgttgattgcatcaggcatggtgatattcgtcagcggtattacgctgctctgggcacgttcgctgattgagataggtaaaccgtagtaaaaacatttcaaagggctatatcacggcggtggattttcgccgggtaatcattaaaatactccgcttattcccccaaattacacgggagaagggaatttgaaatttcatttcatgagatagataccttttcaaattacaatttttacagagggatcgggttggcgtaaccggattcctctgtttccattttactgttatcttttatctcccaagtccaggaatgtcttgtggcaaaattgtgcttaaaacagcataaatcattttttcagtccgtatcaattgttatttgactttttatttcaggtcgttcggcctaaaatactcttttttttcaaagaattcctgtacggattttctatattgaagaggtgatacttgcattatggatttaaagtgtcttaggaaagtattcacattttcatagccgcatttgtctgaaatcaaggatatgctatattgactgctttccagtaatttagcagcttcacatacccttactgtattaatatatttaactaaggtcattccgcagcatcgtttaaattctttgctgatcgttgaaggatgtaagaaaaaaaggtctctcaggcgctgtaaatctattttttcctgataatgtaagttgatatactccttgatttccagcattctttcattcatgacagatagaacacggccccgctttttcgtctcaaatgcacggaacaataataccgcaatttgggtaatgatgcttcgttccatttgcgggcggaacgactcattaaattccacttcatttttcagataacacagcagctcgattatttgatggattatatcagggtttaggttcttataatgactctcaaacagctccggagcaggtgtggaaaaaacctgcatcaaatcgtcttccagatttaagctcctgcaataagaaggttttatggtaaacccatatctgctataggggggctgtaaaattttgctttggtgatgctccatagcaccgatcactaaaatatcatttttttcaacatggtacttttgtccggatatataataatcggctgagcctgtttctatgattaagatttcgctggaattatgaatatgatgcattgcatttttctcatactcacatgttcttgatacattgtaattatcctcgttgatggctttaaaatgttcaggtccgtaatagtcattgatttttatttccatgcttgttttgtattatattctcttgtggaaagagtatatataccggtctaccgactcaaatgatcagagtcataattgagaaattctcagacacaatggaaagatgtgttattattttatatggttgtcagagctaactgtctaaacaaatacgaaagaagtattcatatatgacaataaagaagcagcagagcaaacaattagtggaagatagggggatttctataaaattacagtctatttggaaattatatgatataatgccaataggagcggggttgtaatgaggatataggcagaatcctatgtctgttcaggtaaaactgtagaggaatcattccgttttatgaaggtggacgggagggataaaaaatgtctgatttgatggaaattaaggagtttatccaacggatcgcacaagggatcacatttgcaatcggaatcgacacgcaggtcattgataatcgtttgcagcgggtagcaggaactgtatataaaccggtacctaaaagcgggggagtggtgaagcaggtaattgaaaccggagaatatgcaatcagtacatccgtggatcgcaatagctcggcctgcttagcctgtaatcaaagacagaattgtaaggaaacgggatatatacattgtcccattgtgtacaatgacgaagttgtgggagtcatgggactcatctgctatgaacaggaacatattgaaaaagtaaaggatgagcggagagggcttctgaatttcatacaaagtatgtgtgaactgattgaactcaaattaaaagaagaagatgtgcgccgtaaagaacaagtcatttacaggaagttagataaccagaatcaagtgttaaatcaggtgctggagcagatatcagatggatatgtacttttaaatgcaaataatatcatatgtaatatcaataaaaaggcaatgaatctttttaagatggagcaaggggaagctattggaaagaatattttggacttaatacctgatccggtcttccataatatgattatggaagaaagtgtcaatatatatgaaaatataacaattggaaaagaaagctatggtgccttattttataaggtggctaacgggcgtgaggatttggctaaaatcctgaattttaaaacaattaagaatgtggggagccgggttgctggcgaggcgtatcgtgaaaatcagatcacttttgataatattctgggagaaagcatgcatatgaggcgccttaaggatattgcaaataaggtggccaagaccatgcccaatattttattgactggtgaaaccggaaccggaaaggaaatgtttgcaagagccatacataatgcatcagaccgttgcgggaatccgtttattactgtaaattgtgctgcgattcccatggaacttctggagtcagaattgttcggctatgatgagggagcatttacaggcgcaaaaaaaggcggaaaaatcggaaaattcgagatggctaatacgggaacgattttattggatgaaataggggatatgccgttccatcttcaagcgaaacttctcagggtccttcaggaacgtaaattggatcgattgggcagtagtaaacagattgacttaaatatccgtattatatcagctactaacaaggatcttgaaaaaatggtggatgaaggacagttccgggaggatttgtattatagacttaatatttttgaaattcaccttcctcctcttcgggaacgtccggaggatattcctctcctggtacgatattttatgaataaataccgttcattttttggggttaatgtggaggaggtttcgaaggaagccatggattatctctgccgctaccagtggaagggcaatatacgggaactggaaaatgtggttcagtatatgatatccatgagcgcggataatctgtctggtggtataggaatcagttcattgccggttcagatattggaagttaaaacaccgtctgttcctgtgacaaaacagattagcgggggatgcgacttgaaaaccgtagaaatggctcagataaaggaagcaatcaaaaaatacggaaatacgacagaggggaagaaggtggcggctaagaatctgggaattagtttggctactctgtacaggcgtctcaataaagaagtttaaacagaattctcataatgaaaaaaattttcattatgagaattttttaaaccttgatctgagaaaaatgagaaaaatacccctgctttttgcataaaaaccgtggaaaataagttggcacggaaattgctgtatatattgacaaaggtaattgattaacctttatcaattttataagtacaggaggaaattatgcagagcagaattgtagtaacaaaaaaaccaaatgaagttgtattggagaacgttgatttggaggtgggggacaatgaagtactggtgaaaacgtatatgtcatctatttgcggtactgataaaaattattcccttggaaagatgccccgggaggttctgattgaacaggcagcaagtaacaatgaggcacatcatgcttatcctttgaaaatgggtcatgaagcagctggtgaaattgttgaagtgggtaaaaatgtaactgactttaaagtgggagacaaggtaatgtcttttggctggtataataccatggcagattattttgtggctccagttgtacataacggatatggtgtggtgaaggtgccggaaggtatgagtatggaatcggcctctttaggtgagccgactgcttgcgcaatttatgcaggtatgcagtcaggtgtggagcttggtgatgttgtagttgttgtaggtgttggctttgccggacagattatcgcacaggttgttaaaaagatgggtgctgcaaaagttatctgtgttgatattattgatggaaagctggagctggctaagaaaatgggagctgatattgtgttaaatgccagcaaagatgacgtagagggtgttgtcatgaaagagacaaacaacttgggcgcagatgtggtaattgaagtggctggaaatgataaggccatccagctttgcagtgatgtgctgaaacatggaggaatcatgggactttacagctgggtcctggagccaacaagcctatacattaacagatggcataatgatggttttgatattcgtacactggcgcttatgcaccgcattaaaattgaccgtatttggtggattgaaaagaccctgcagaatgtggccaacggaatgatacatattgatccattgatttcccatgtattcagtcttgataatgcaccagaggctttcagggtatcatgtgaagatccaaatgcatgtaaagtgatgctgaaatcataaaaaacaaaaagaaaaggagtcgtattatgaagaaggttatggggttagctttaagtatggcattattggcgggattgcttaacggatgttcaggaaataacggaggacaggcatcctcagcagtcagtacacaggcacaaacaacagaaagttccacaccagctgcttcctttgatggaaaggtggtgttgggagcaactgccccttaactggccctaaccagttgacaggcggttattatgtaaatggaatgaagatggctgtggatgagattaatgcggccggtgggatacttggtaaagaattggtactggatgtccaggacgaaggcacagaccagtccatagccattaatgcaaccattaagctgattgaaagcggggttccagccgtcattggttcttatttctcaacaaactgcatggcggttcttcctgaaatagagaaaaataaagttccctattttgccaatggatcaaatccggatatatcagcagcaaacaatgaatatgtatggcagatacgtgtaacagatgattttaccgggccgattatggccgatatagcaatgaatgaattaaatatgaaaaatccggctgttctttatacaacagcatcttctaccacgattcagaaggacaattttgttaaagcaatggaagccaaggggaatgctgtatctgaaaaaaatatatatggtgcccctgaaaatgaatcaaatttcagttccatcattaatcagattttaaattctggagtggacggtttggtagtgatgggagtcagtgaggcttgggatgttgccctggctcagcagcttcagtccgcaggctgtgacattcctcttatgggttcatccagttttgcaagtgctccatttattgaagtggcgagggaagctgcaaatggctggtacaccatagcagattggtcacctaacattctggagggtgatctggatgtgccggatcaggcggtaacctttgaaaaactctatgaggagttatttgacggtatgagtgccatgcagtctgcatggggatatgactgtgtctatctgttcaaagaagcatgtgaacgggctggaaccactgaggacagggaaaagattaacgaagctatgaaggatacggatatgcagggcgccaacaattattataagaattatgaagacacttttcatgtaatgtcaacatacatcctgctctgtaaaacaacagatggagctgcaacacccataagaaaggttaacttcagataataagacaggcttttcagccagaaggcgcagatgatgcgcctctgcgctgacaagcggaacggcagaattgggggtattaaattgacttttagtttgtttttttcattgttggtaaatggactgtcaatgggaatgatttatgcaatgatagctatggggctgatcctattaatcagagcggttggggtccttaattttgcacaaggtgacttactgatggtaggtgcatacatagcctgtgtcctgtttatggattttaaacttccgttttatgttgcaatgccgctggcattggtattttacggtttaataggattgatattcatgatggttacctattggccgctgaggagagcctcttatgttgtggcgccgattattgcaactatgggagcttctctggtgctgtccgaaggaaccatgattttgtttggttcctggcccaggacgattgttcccctgttgagtaattccaagggaagcgctttgacgatcaatttatttgggacaaggctgcaggcccaatttttattaattatagcagttgcagtggtggtaatgtccctgatctatctgctgtttgaaagaacctatattggtatcatgatgcaggccgctgcccaggataagccggctgctgaacttatgggtatttctacgctgatgacaactgcagttacatatatactggtaacagttctggtatccataggcggttacatggtagcaccaatctacacagttacaacatctttgtcagcgctgcagctccgtgcctttgcaggtacggtaataggtggatttggaagcattaagggtgcaattatcggatgtcttctggttgggacagtggaatcttttgcaactgtgaaattttcttcttataaagatgcgattgtttttctgattctgatcattttcctgattttcagacctcagggactgattgtagacaaagtcgctgataaagcttaaggagggaatcagaatggataaaacaatgataagcagggggcggtttgctgaccccaaaaactggattacagcaggcaccctgatactattttccatgtttgtggcattgaaaatgaataattatacgattttggttgtgaatattgcattgattaatatgattacggcatatgggctttctatcatgctgggaatgtgcggacagctggtattttcaggagtggcatttatgggaattggggcctataccgcagcgaacctttgctccggacgtttgggttttgtagtccccggtgttggggctgtcttactgtcagttgcctttacagctcttttttctcttgcaacaggtgttttatttcttcgtttaaaaagttcattttgtacctttgcgaccctgggatttgtgcaggtattgtacaccttgtttttaaattatgaaccagcttttgggggacctaaggggataccggagatacgtacattggctataggcacttttgtatttgacagctataaaaagtggtattttttattgattactttggtcttactgattgcattttcagtggagaggatccggcgtaccagcctgggacgttcccttgcatccatcagggataatgaaattgctgcgcagacgctgggtgtaaatatttatcggacaagggtcattgcatttgtgattgcaggaacctttgccgggctgtcgggtgccctgctggcacagcataaccgttttatctcaggcgatcagtttagttttgctaagagcacgaccattgtcattatgtctatgcttggagggattaacagtactccgggtatttttataggcgcattgatcgttaccttcctgccggaggttctcagagggcttgataaatatctgatgttcatatatggaattgcagtcattgtcatgatgattttcatgccaatgggaatcggcggtgcggtttcagatcttctcaaaaatatgagaagaagacgtaaactaaagtagctggagatctgaggaggaaattatgggcgaagcaatattgaaattggaaggcgtatgtaaaagcttcggcggtgtcgtaacagcaaaaaatgtggatcttaaagtgatgccaggagaagttcatggactgattggacccaatggagcaggaaagagtacaatgatgaacctgatcagcggaatttacgatgtagatcatgggtccatattttttaatggcgggcagatcacaaaagtaccttcgcatatacgggcaagaaatgggatcggaagaacctttcagacaccccggtttttatacaggtcaaatataagagataatctgatgctgggagtggatcttcatgatcagctggggtattttaaaagtttcatcggtacccggggaagtgattttttgaaggaattggatcagttaatggaattggcaggatttacatttgactgggatgaggatattacagcgataccttttggtcaaagaaaaattttggaaattgtcagatccatgttaggtcatcccaaagtgatgttagtagatgaacctgccgcaggccttacaacacaggaaatagaacaggccagaaacctgctgctgtttgctgccaaaaagagaaacatcggtattttattaattgaacatcagatggatctggttatgagcagttgtgagaatattgatgtcctggtatttggagaaattcttgccagaggtgtgccggaagaaattgctgcgaatccgattgttctggaagcctacttagggagggactttgatgattaagataaataatttatatgcatattatggtccgattgaagctctcaagggaatccagatggtagtcggcaaaggaaaaatcacctgtctgatcggaagcaatggagcaggaaagagcactctcatgaattcaatttccgggacaatcacccgcaaaggctctattatagtgaatgatgagattgaaatattaaagaaaaattcccgtcagatcgccagaatggggattatccaggtaccggaaggcagacatgtattcccggggctgtctgtggaagaaaatcttcagacagggactattgtatggcatggatatttcggaaataaatcttatgctgctgagctggaaatggtatatgagatatttccgaggctaaaggagagacgtaaacagctggcgtggagcatgagcggcggagaacaacaaatgctggctataggaagggcattgatggccaggcctaaaatccttttgctggatgagccatcgatgggattatcaccgctattagtaggagaaatgtttgagaaaatagcagaaatcaataaaacagggattacgattctattgaatgaacagaacgcaaggcttgcaatgaagatttctgactacacttatgtgatcgaacaggggaagattaaaatgcaaggcttatcgtctgaaatgagaagtgatccgagaattgcggaagcctatttgggtaatcgtgcggggcagggcaggaggagccagaaagcgccggcaggctaattctatggagtagatagaaaggggttaataatgaaaaaactgattaatcaaccggaaaattttgtaaaagagaccatggaaggcattattgctgcctatggagataaagtgaaattattagacggtgactatcggattttactaaacaattataaagtcagagaaggaaaagtaggcatcgtaacggcaggaggttccgggcatcttcctgtatttttaggttatgtgggtcaggggcttttagatggatgtacggtgggtaatgtatttgcttctccggcagcgtctaagatggcgggtatgattcgtgcatgtgataaaggaaacggcgttctggttttgttgggaaattacggcggagacaggatgaactttgaactggcctgtgaaaccgtagatatggaggatgacatccggactgaaatggtactggttagggatgacatagccagtgctcccaaagagaaaagggacagacgccgcggggtggctggaatggtttatgcttttaagattgccggtgggaaagcggaaaatggcggcacgctggaagaagtggcagaagcggcccggcatgcgctggataatatccgtacaatgggagcagccctgtcgtcttgtatcgtgcctcaggttgggaagcctacttttacaattgctgaagatgaaatcgaaattggcatgggaatccatggagaaccaggagtggaagtccgaaaaatgatgactgcggatcaagtggctgaagtactgctgaataagattacagaggatatgcctttgaagccgggagatgaggtttctgttatggtgaatggtctgggtgccacaccgttggaagagcaattcattgtctaccgcagggtgcatcagatattgagtgagcaggggataagcatttatatgccccatataggagaatatgcgacctccatggaaatggccggtttatcgcttacagtcatgaaactggacgatgagctgaaggctctgttagagcagccggcccagtcgccattctacacaaatttcaataaatagaccgggaggataaggcatggatgcacagggattagcacgggccattggccggattagccggaagatagaagaaaataaagattatctagtaaaactggatcagcaaaacggcgatggagatttgggaatttccatgaatgacggttttaaagcagtgtgtatgatcatggaattatcagaagaaaaggatttaggcaagctgcttatgaaggctggaaatgcgttcaatgaagcggcgccatccagcctgggaaccatcctttcctttggttttatgggaatggccaggagcttaaaaggaacaatggacgctaccccccggcagattgcagacgccctgcatgcaggggtggataaaattatggaaaaagcaggttccaggccgggggaaagaaccattttggattccctgtatccggcggtggaaaccttagggaaaaagcttgaagaggaaaatggagatttgtataaggctctgaaagaagcggccaggatagcggctgtaggggcagaagccacgaagcagatgaaacctgtacatggaagagctgcttattatggagaaaaaaacctggggtacttagacggaggagctgttgttggaaggctgatttttgaagctttgtgcggggattgatttgggaggaaaatgtgggcggactataactttgaattgcatactttccttccttagaaaatacatggagcactatttcaattaatagattccaggaatatttggtggtaaaatatgttgaaaatcaacttaatttatcgtatcattaaagtattgaaaggagtgcagctcctgcacattacccagcccatgctgtggcataggggaaataccaagagagttattgattaagaatgagtttgtatttgtcaccggtactgacagtgatcagattgaggtctttaaaataacgggtggtcaacggaaagacctggacacagcctttgccgtttgcagtccaattaccttctcagttggcgggaatgtttgattttattgatccaaaggaaacgtatgaagggggaagaaaagaatgcagcataaaagattaaaagattttccggaggatttcctgtggggagcctccacttccgcttaccaggtggaaggagcgaatctgattgacggaaaaggaccatcctgtcaggatgtaaaaaaggtaccggaaggaacctcccaactggatgtatgcgcggaccagtatcatcattataaggaagatgtggcattgatggcggaaatgggatttaagacttaccgcttttccattgcgtggtcacgtattttgccggaaggcaccggaagagtcaatcctaagggaattgaatattataaccatctgatcgatgaatgcctgaaatatcatattgagccgtttgtcaccatgtttcattttgacatgccggccgctcttgatcagcggggcagctggggaaatccggaatccgttgactggtttttaaattatgccaaagtactgtttgaaaatttcggagaccgtgtcaaatactggcttaccataaatgaacaaaatatgctgacgctggtggggccagtgatcgggaccctgttcctgccaaaaggctgtacaaatgtgaaaaaggagatctatcagcagaatcaccatatgctggttgcccaggcgaaagccatggctttgtgtcatgaaatgctgccccatgggaaaataggaccggcacctaatatttcattggtatatccggccagctgtaagccggaggatattctggcggctcagaattacaatgccattcgcaactggctgtatctggatatggcggtttatggagtgtacaacaatctggtatgggcatatctggaggagcataatgcctgcccggtgttcgcacccggcgatgcggaggcgcttaagagcggacatcctgattttatcgggtttaattattataatactgccacctgcgaggcgagcgacggaactgagaccatggatccgggagcggatcagcagactgcaaggggagaggcgggattttataaagggttcaagaacccgcatctgccggttacagaatttggctgggagatcgacccggcgggatttagggctaccataagagaaatgtattccagataccgtctccccatgattgttacggagaatggacttggcgcttacgataaactggaaggagaaaaagtgcatgatccttaccgcattgaatatttaaggagacatatccaacagattcagttggcaattacagacggtgctgagatgatgggctattgtccctggtcggccattgatctgatctcaacccatgaaggcatggtaaagcgctacggttttatctatgtggaccgggatgaatttgatgtgaaaaattgtgaccgctaccggaaagattcattttactggtataaaaaggtgatcagcagcaatgggaaggatttgagttaaagctgatagacccatttaagggctggcaggacaggcttgcgaaatctgagggacggttgtgtttatttatgaaggggataaagagggctgttgcactgattagtgcacagtcccttttatttatgggtattagcctgttgaacaagggtgagtttctctttaagagttatctgtgcagactttctctatgcgtagagttgcggatattataacatggtgatagaatcattttaagaacaaaaaattatatactagtgaggtagggagcgttatgagggacaaaataaagttaataatcgggcaggaggataagcggaatcctcttacggatgaagccattgccgatgaattgggaacactgcgcgaaactataacaaaagtccggatagaaactggaatccctgcttcatcggaacgtagaaaagaacgattgcttcaggagatccaaggtttattttatgaaatgggattggtatcagatcgtaaattggcagaattactaaaacaacgagggtttaagatcggaaaatttaccgtcggacagctgcataaatcttaccctgaaatatgggagccggtgattaaatattctcaggatgaaacaccggtcagcgataataagctggaatttcaagatgacattttccataagattatcggttcagacggtagtctgaaaaatcaaatcagtaaggcaaaggcggcagtaatgtatccaccaaaagggctgcatacgttgttatatggtccttctggtgttggtaaaagttttttggcagagctgatgcatgattttgcagtcagaacggataatttccaggaagaggctccttatttcgagtttaactgtgctgattatgctgataatcctcagctgctcctggctcaattattcggatatacgaagggagcatttacaggagcaactgaacataaaaagggaattgttgagttgtgtgacggcggtatcttgtttctggatgaagtgcacaggcttcccgcagaagggcaggaaatcctgttttacttaatggataaaggcaagttccgccgtttgggagaagcagaaaccagccgtgaaagccaccccttaattatagcggcaacgacggaggatccggaaagctcgctgcttttaacgtttcgccggcggattccaatgagcattgaaattccggcattgacagaacggcctctggaggaaaaatggcagtttatcgagttttatcttacgatggaaagggaacggcttggccgtgatatccgtgtaaaccagtcggtattaaactgtctgcttttggcggaatttccaggtaatatcggtcagctgaaatcagatatccaggtttgctgtgcgaaggcattcttagaggcaaagcttcataataaaacagcgatagatgtagttgcggataaccttccggagcacttaaagagctgcatcaatcaatcggttcctaatggtatacggcatttaatcagcggggatgtccttttttcagaggcgggataccagcagttttcaggacgtttacacaagatgagcggtaccggtatttacgaacagctggaagaaaggtatacaaagcttttgaaaaatggggtagcagcagaggaaatcagcaggatcttgcaagatgaggttgaaacaacgctggttcagcagattcgcaaaatggaagagtccaaattcagcctgcatgagctgtccgcaatcgtgggagaagatgtactggagataacggaatatatatatcaggaagcgcagaaagaattaccgggacttaaagatacgattatttttcccatggccattcatattcgcgcgtcactggatatgaccaaagagagaaaagtggcgcttggaagcagttttgaagaaattaaaaagcggcatgcaaaggaatataaagttgcagctcatatcgttgataaggtcaatgataaattctatgtgatgcttccagccgacgaggcagtctttttggcaatgtatctcagtaagtttcaggtaggacaggttgatacagaaggaaaaacagctgtgattgtgctgtcccatggaagagtagcagggggaatggcagaggttgccaataaaattctgggagtaaaccacgccgcagctttggagatggctttgagtgaggatccggcggctgcctatgagaaaacaaaacaactggtaatcgaaagaaaccagggacgaggctgcatcctgcttgcagatatgggatcactcctgacttttgcagagaagatcaggcaggagacaaaaattccggttgctgtctgcgggagggtggacaccttaatggtgatcgagtgccttcataaagtactttggacagaagagtcaattgaaacaattgtagatgaacttgacagtaaaaaaacattgcagcctaaaacagctaaatataataaaattcagcataaaagagcggttctttgtctgtgtatcaccggacagggagcagcaaagctgcttcgggattttatctcagagcggttaaaatcagtattggacaatattgttatcataaacagaggctatatagaaaatgaagacgtggaacaaatcattctgcaggaagcggctcaatatgaaatccttgcgattgtcgggacaattaatccggaagtaaaaaatattccatttctttccctggatgatatctatcagtcttccggtatctcaaaactgcgtaaaatcattaaaaacagcctattgctggatcatgtcattcttggtgaggtcattacaccggaattgatctttgtgaacccgccattccggttaaaggaacagcttttagatcaggcgatcgagacgatgacaagcgagggatatgtggacgagcggtttttactaagtgtttataaacgggaaggaatgatgaccacttatttaaaaggtggtatagccattccacacggtgatccggccagtgttacaaaaccagtcatatcgataacaaaacttgacaaaccagtgatgtgggatggtacaaatacggtcgatctgatctttgtactggctttggatgaaaattcaaaaaaatattttgaacagctttatcagatgttaagcagcgaaaacctggtaagtttaataagaaacagcaattctatcaatgaaatcagggaaaatcttcgtctggacacaaaaccggtcaattaagttggcacgattcttgctctatataatagcgtagaggcaagaaaggagtggaaagatgaaaaaggaagattttccaaagattacagtcattttgagagggtatacccattctcaaatcagaaccgtggtgaaaagtcttctcggcaccgcaataaaatcagtagaaattacaatgaatactcctgatgcgattgagattatcaaaagcatcagtaaggaattcggtaatgatatactggtcggtgccgggacggtaaccacctatgaggaggccgatgcagcaattgcagccggtgccagattcttattatctcccattacattcagtaaggaaattattgagttatgcaaagaacaggggttatttctgtccctggggctctgactccgtcagaaattatgcagggcataagggatggagcagatattatcaaactgtttcccgcaggaattatgggagcagcttatttaaaggatattcaggcacctcttggcaagcttcctctgatggtagtaggcggtgtaaacggcagtaatgtcaaggagttttttgatgccggggctgcttatgcgggaataggttccggattgtttaaaaaagaggatataatcggtgaaaatctgtccgggctgaaagcatctgtacagaagctgacagagcagctgatatagaggagaatatgaatgagcgaaatagtttttgatgaatcattgatactggagctggaaggaatagaggaaaataccgaagcactgacccagctaacggattatttgctggataaagggtatgtgaaaaaggggtataaagaggctattctggagcgtgaggctatgttcccgacaggtctgtcaacaggtgaaatcaatatagcaattccccatgcggatacaagttatgtcaatcaggcagcaatctgtgtgggaattcttaaaaaaccggtaaaattcagtgcgatggatgaaccggaccatcaaattgatgtgaatatcatcatcatcctggcattaaaagaggcacatggtcatttggagatgcttcaaaaggttgtggagttaataaaagatcaggagaatttaaaaaaaatcgtaacagccagcgatacaaaacctgtttacgatatgatatccagccatctattacagcagtaaatatgaaatttaaccgaatcaagcagcgaagcggattgcgaatatccgcttgaccagaaagcagtacttaaaaattacgggatcagattggagaaggaaatgaaaagaatattagtagcttgtggaaatggaatcgcaacatcaacagtggtaggtacaaaaataaaagagaaatgtgaagacagcggtattgacgttacagttacacagtgtaagcttctggaagtggaatccaaagcggaaaactttgacttactggttacgacaggaaagttcaccggtggggatgtgggaatcccggtgattggagcaatctctcttttgaccggaatcggggaagaggcgacgttggatgaaattattgcaatgttaaagtaaatataaaactaaggagaagtgatcatgcagattatatattctatatttaatacgattttggctgccggagcggttgtgatgcttccgattattattacggtcatcggtttgatttttcgcgtgaaattagcaaaagcttttcgttcaggactgacaattggaatcggttttgcaggtattaatctggttatcaatatgatgaaatcaaacctgggaccggctgcccaggccatggtagaaaactttgggattaaacttgatattctggatgtgggttggggagcaattgcagcggtaacctggtcgtcaccaattatagctattttgattttctgtatactggcaacgaatattattatgcttgtacttaaggcaacggatacgcttgatgttgatatctggaactatcatcacatggcaattgtcggtattatggtttattatgtcacgaaaagtatacctctgggaatagccgcaactgtggtaatggcagttattacctttaaactctctgactggacggcgccactggtagaagactattttgggattcccggtgtttctctgcccacaatgtccgcattgtcttctgtgatcattgcggcacccctaaactggctgcttgaccgaattccaggaattaataaactaaattttgatgtaaaaaacgctaagaaatatttaggctttttcggtgaaccaaccatgatgggattgatattaggctgtatcattggtgccctggcaaaatatccggtatcaggaatcctggcattggggtgaatatggctgcagttatggtcttgattcctaagatgacctctttatttatggaaggcttaatgccaatttccgaggcggcaaaaaaattcactcaaagcaaatttaaaggcagaaaatttcttattggactggatgctgcagtggtagttggtaatccggatgttattacaacatcgttgattgttatacccttaactattttaatggcagctgttctgcctggaaaccgtgttctgccgtttgctgatctggcagttgtaaccttccgtgttgcattggtggtggccattacaaggggcaatttatttaagaatattatcatggggcttgtttgtactggtgtgatattgcttgccggtactgctaccgcaccggttcttaccgagttagcaaccagtgttggcttaaatctggcagcagatggaagttacataacctcgtttgcggcaaccagcctgactgtgagttttttagtttacaaagcatttatcagcaatctggtcatcagcattccggtattgcttgcagctatcgccggtacctgggtatttatgagtaatttgaacaagaaaagagccagaatattagaagagaaaaagcagaaggaagctgtaagtttaggagcagaagtatgaaaataacagacgtaatcgtatatacagtaaaaccccggtggatttttgtgaaaatagtcactgacgagggcattgagggctgggggagatggtttccggaacgaagaccgagacagtggtagccggtacaaaggaaatggcaaaacggctgattggaagaaatccgttggagattgaaactctctggcaggaattataccgtgtatttttccgcggcggcccgattaatatgacgatcatctccggtcttgagatcgcactttgggatattaaaggaaaatattataatgcccccatctatgatttgatgggtggggccgccagggaacggattaaggtctactcctggattggcggagaccgtcccagcgatgtggtaaaggatgcacaggaccgggttgacagaggctttgactcggtaaaaatgaatgcaacagaagagcttcattatattgataattttaagaaaattgatgaagtggtggcacgggttgccgccctgcgggagacttttggcaacgatttaaatattggcgtggattttcatggtcgtgtacacaagccgatggcaaaggttttggcaaaggagttggagccattccggccgatgtttttggaggaggttgtgctttgtgaaaatcaggaggcgtttaaggaggtggcggagcatgtggtgacaccgctggcgactggcgaacggctttatacacgctggggatttaaagatattttaaaaagcggatatattgatatcattcagcctgatgtggctttagccggcggaatcatggaaaccaggaagattatcgctatggcagaagcctatgatattgcagctgctccccatgctccctatgggccaattgcactggcggctaccttgcagattgattcttgcagccccaatgtctttatccaggagcagtcactgggaattcattataacaaaggctttgatcttctggactttgtagaaaataaagaaatattccagtaccaggacggctttatcggcttaccggataaaccgggtttgggtcttatcatcgacgaagaaaaggtgaaagaagtgtctatggaaggactgaactggtccaatcccaactggaaacattatgatggaacaaaggctgaatggtaagatccgtgatatatgacatacggggagtataaaatcatataaaaggaaaggatcccacactcagctgccgccaatgagaaagtatcaagtaagcctgacatattacgtgctgttgggaaatgccactatgtattatgttcatttttgtagtgaggcagataaagttgtacaagcccattttatctgccttttttcaatttacatcatagggaaagatatagtgcatatagttttaaagaaattcacatggatatcccttaattgccggcagttttccctgtacggcgcctgcgtggcttttccgcagccatttggaaagatccaggaagaggctccttagaggctgttcatcagaagtttccggttatccttgactaaccggtactgtacatgctattctaataaaacaactaaaaatgctcaattgagggagtagtttgcgcggcttttcgcgtggcaagtcaacatactgaccgtgcggtctggcttgtcttaaaaaacgagactcatgtgtggttttcccatgcatggtcttttttatttgactcatgtatggtacaaaccatgcctgggtcttttttgttggaataaatggaggagattttgcaatgaacgaatttatgacaacaaaagaggtgctgttggatcacctcaaaacagattctgaatcaggattgacatcacagcaggcagaggaaaaccgccaattatatggttcgaacacccttacccggcaaaaaccggaatcattattcagacggatatggaaatccgccacggaaccgatgattatcatgttgattctggccgggcttatcgcccttgccgtcaatatttttcgaggggtaacaggcggcgaagccgattatttggaatgtgtgggcatttttgccgctatttcactttcggtcatcattactgttgtcatggaaggaagaagtgcgagagcctttgaagcactttctcaaatcagtaataatacagtcattaaggcaatacgcgacgggaacaccgtcatgctggatcagaatgaaatcgtggctggagatatccttttgctttccaccggggacaaaattcctgcagatggcagactgcttgaaagtgtcggtctgactgctgatgaatcggcattaacaggagaaagcgttccggcaaaaaaggatgcggaatatattatagcggatgaaaaactgccgcttgcggaacgggccaacatgctctactgcggaaattttatcacaaacggccactgcaagatggttgccatctctgtaggcgattctaccgagtttggtaagattgcccgcgagctgacagaatcgaagcaatccagtacgccattacaggaaaaactggcacggcttggaaagaccatcacaatacttggtgtgatcgccgcttttaccgtgtttattgcccagctcatttcttttgccgtacaggaagggctggcattggaagaagttatggaagcctttgtcaccagtattgtgctgatcgttgccgctgtaccggaagggctgcccacaattgtggcggtgtccctctctatcaatattatcaagctgtcgaaacaaaacgccctggtcaaaaaaatgattgcttccgaaacggttggctgtataaatattatctgttccgataagaccggcacgctgacggaaaataaaatgacagtaggtgctttttatgatacggaatggcacaggaataccgctgagctggtatccggttggctgattcataatatctgcctgaacactaccgcagatatcagcgaggatggtacatttatcggcaatccaaccgaatgtgccctgttgaacttctacgagaattcgtccggacgaaaaagcagcggcaaatcataccgcgatgaacgcagcgatcacaatgtcctgcacgcctttccgttttcgtcagagctcaagcacatgaccacaatttcaaaggttgatggaaaaattatttcctatgtcaagggcagcccagaatgtatcttttccatgtgcagcctgtcttatgaagcaaaagcccatattgaaaagcatatgatacatgcacaggaaaaagccatgcgcgtgatcgcttttgcacacaaggaactcctctctatgcgggattatgaggaagaaacagcgcatcaggcaatggaaagcggcatggtgtttgacggatttgtggccatttccgaccctctgcgctcagatgtgtatgcagcggtgaaatcctgccgtggggcgggcgttgggttgaaaatccttactggcgacaacatcataactgccacagccattgcaaatgaattgcatattttggacaacggttctgttgcggttgaagcgaaagacattgcggatatgagcgacgaggaactgtctgctaagatacagaccattagtgtcatcgcccggagcacaccaacgattaaaatgcgtattgtaaagctcttaaaggcacagggcaatgtggttgccgtaacaggtgacggcataaacgatgctccggcgttaaaaaatgctgatgtgggaattgcaatggggatttccggcacagaggtttccaaggaggcaagcgacattgttctgctggatgattccttttccaccattgtcaaggcagtggagtgggggcgcaatatttatgaaaacttcaagcggtttatctgcttccagctgactgtaaacctttcgtcagtcattgttgtatttacgtcgattcttttgggattaaaagcacccttcactgccttacaattattgtggattaatattataatggacggccctcccgcattgaccctgggtttggagccaaactacgatgatctgatgacacggcagcccacaaagcggggcgaaagcattgtatcaaaagcgatgctgggccggattgctgtcacaggtgtttatatgtctgtcatttttctgtgtcagtatctctttaactttttggatgcaacaacagaccaaatgccgacagttttatttacgctgtttgcattgttccagcttttcaatgcttttaattgccgtgaacttcatagcaacagtatttttaagaatttattaaaaaacaagctcatgctgctggtagttggcaccacctttattctgcaggtaatcattattcagtttgccggtgcattctttggtacaattccacttgatcttatgatgtggggtaaactcttcggaacggcgtccagcgtggttgtgctgtctgagcttgtaaggctgtgctggagatgtataaagaaataggagagttaaatcagtcagtgcgatcgattcctcagcggcggatcatatgatagaagaactggaaggcagaagtcttcagttgttctctaaacgaaacaaagaactgataccaatacgaaattacgcaatttccagacggaagagatcacccggcctcttccgttttttcttataatcattatatctgtacacacatacttttttacgggcaagccttttatgaataaacgttcttttatggatatttcaagctgccctgtcatgttgtttcacatatctgttattttgctttcgtaaccacagtttttatgtatataatatgatctttgcaataaaaatatcttttcccttatattccgaaagattatacgaaaagattctaaggccgcctgataatcagaagcaaaagttaaacttttgatatgtatgttattgacacaagtccaatccattgaatacaatttttgttgcttcttccagaatctcatttgtgttcagcttttattcctattttcttatcaaaaaaagcggtagctttgattgcgtacttttcaaaaccaccgcttgccataaataatttagctcaaaagttatttacgtctaaccggcaggaccctggaaaaaaatattatattttgagtaaaaatatcatttcttctccatatccggatcataaatttcttctgaaaattccgttaaaatacgccgatgctcctgtgttcccgccggatattgtttctgttggggcagtttccgtttgcttgttgcctttacaattgcatagcagaccgtaaaaaaagcaacgagaacaatacccgcaaggaaccccaaggtttgtccttttaaaaatggcatgctgaacatggctatgatcagtccggccatggtaaacagggaactgtagggaaatccgcacagacggcagtttccttccggtttcccgttctttttccggaaacggatatgagtaaacatgagcacaatataagtgaaaagcaaagcgaatcccccggagctgatcaaaaacagatagactcccggaagaagcagtccaacgtacagaaacagcatcatacataagccggaaaataagattccccggtaggggacatcggttttgtcctttaagaatgcaggaccaagccgttcatccacaagagaacggagcattcttccgattccaaacatggcggccagcatagtagacaaaattgcactgattaatataactgtcatggcagtgccggcccaggtcatttggtagcggtttaaggccgtaaccatggggcttacgttttcgcttaacgaatcgctggggaccagcagcaaaagaactgaaatacacagaatgtatagtgttaccagccagaaaaccgttaagtggatggcgcggggcacatttttttgtttattttctgtttcgctggcagccagtccgatgatttcaaaacctgcataggtgaataaaacgatcagcatgcttcctgccaggctttttaagcccccggggagaaatggctctgatcgcaatatgctgcttcctaagggacgggagccaggtaatacacccaatacgatcatggaacctaaaagaataaatccgataatagcaataatctttattgctgacagaacactttccagatgacttagctgttttgcacccaaaagatttaataacgtgaccccgacgatcaaagcagtgcccagaattgggattgaaacgtccggaaaccatgtccggaatagcaaggcaacggcggtagcctcgctggacatggaaatgaccattccggtccaatagacccagcccaccacaaagcctgtgccactgtttatatactgagaagcaaatgttcggaaagaagcagaatccggattggataccgtcatttctgaaagcgcaaataaaatgaaataaaccataacagcgcaaatcagataagaaagaataattgccgggccggcagcctgtatggcaaccgatgagcctaaaaaaaaggaacctccgattacggttcccagagccatcatcgttaagcggcctgcagtaagaccttttgccttatttttcataggattcctcgcttttaatttttgtattattatttcatataacggaaaagttattcgaaacattgaaaatacattgataaagcttaattaaagaaaaaatttaacatcctaatttccggcatagatcaggacctcaattttaaagaaaccaggaaagaagtttctggaaattcgacaaaattcgtagtataatgaaatggaaatcaatgatcatgaaaaaattacagtaattgaggaaaaaggatgctaaaacggcttttgatcatcagcgcagtcaccatagttggggtgctggcgcttctgctgtccatgctgtggggcaaggaatatgtcccggaaacccggctgactgcaaaacagggcagaatggatgcctccgcgtggaatatagatcgtgaccctgtcctgcgtctggacggggaatgggaattttactggaataagctgctaacgccagaagatttccaggctgaaagtacttcacaatccgccgcttatatgcaggtcccctccttatggagtaaaaagacggtgcagggaacaacacttcccgtttttggctgcgcaacctacaggctggtgctggagcaggtcccatttcggggaagactggcgctgaaaaaagtcaacgcgcgcttttccagccgggtatatgtcaacggacaggagttgcttgctgatggaattcctgcacagcaggcagagagttaccggtccggcaatacaccgcagctggttttttttgaaaattacagcgggagaattgaagtcatagttcaggtagccaattatgagtatctcaattccggcattccggcatccctggagcttgggcgggaggataccatgctggagcggcaccagcgcaaacatctggcgtctcttttgatttttgcaaccctgtgcacaattgcccttttacatatgattttttttatcattacccgggacggtgtgctgaaaaatcccatgcttttgcttttttccctgttctgttttttactggcgtggggaaacgggctttctgatcagcgttctttgctgcttcttttgccggatattccctttacgttggcttttaagcttaaggatatctgcctgtccgcagattttatcgttgtgatttggatcttctgtaaattcaggagcggtctgcttcagctgcgcttagcccgtctggtttcgctggcatacagtatctatttggtgatgattctggtactgcccatccatgcgtattacaaaatccatgcagctgtgatggtgtgcaatacggttgttttgctggtgcttctgatccggtcggttcgtctatatgtccggaatgcggaaggctttttactgtttgtggccctgctgtcggtgaatctgtattctgcggatgcgattttgttttctttgggaatcaaggaaagctccggctttattcaggtgtttatcctatttttcaccgtagtgatgatcgcgtacctgtccatggaataccgcaatacggttgagcgcctccgccgttccatgaagaaggctcaggaggcggaaattgcttttctgcgggcacagatcaagcctcattttctctacaattctctcagcgtgatcgttgcgcagacaacccaggagccccaaaaggccaagaacctgctctatgatctgactgattatctgcggggcagctttcactttgaagcacatgacggcatgattcccttatccggagaattgaatacggtaaaagcctatctttccatagaacaggcccgatttggggacttacttgaggtggtttatgatatcgaggaaggtctggacaccatggtgcctcttttaagcatccagccgattgtggaaaatgccgtccgccacggtatcttcaaacaggcggagggcggcaggctttttctgcagatccgcagagaaaatgattttgttgtgatcaaggtggaggacaacggcgttggaattccaattgaacgtttagatggaattcgccggggagactgtcccgctgccggagtaggattaaaaaatatacagggcagacttgagagttacaaaggcgcccggttgaagatcgaaagtacggagggagtcggaacggtggtgactcttgaaattccatatagggaggtattgcatgagggcgattttagtggatgatgaggagatgctgctgcgcgagatggaacggctgcttgcaagctatccggatcttgagattgcgggcagctatacagatcctatggaggcactaagggaaatagaatcaacacggccagagctggcctttttggatatagaaatgcgtaccttaagcggacttgagcttgccgagcggctgctgcagcgaaatccggatttgaacgtgttgttcgtgacggcctataaccagtatgccgtggaagcatttgagatcaatgccattgactatattttaaagccggtccgtcctgagcggctggaaaagactatggagcggatacggcgtaaacggggaataccgcagccgccagagactcttcggatacagttttttggaaaattcagtatttatctgggaaaagaagctgtcaaatggaaccgcagcaagccaagggaactgctggcttattttcttgcaaacgaaggtatttggctggataagtttaaaatctgcgatgacctctggccggaaaacagtccaaaccaggcattgcgcaatttgcagacagcggtctgggccattcgcaaatgtctgcgggaatatgggatttctgccgcgtccattgcctatgcaaatgacagctatatcttcaatttaaaggattcccagtgggatgtgcggcggtatgacgaggcgttccggctgtttatggcaaccggcagttctgctgcaggatgtgaggcagctgccctgtatacggaagattacctggcgtatgaggactggaactgggcaagggagaaaagagcaggttacgcaatcaagcaacagagattacaggagcggttgtccgcagcaggaagaagcaccgctgtgtagagcagatcaaaagaaccggattaaagttggctgataaggctgattttaatccggttcttttgttttgcgccgctgtgttgagaattcgttgagaggcagttgatataatcataattggaatattgtcgaaaaggacagaaataggagaattcttgtatattccagaagtggagacagaaggaggaagacgtatgatgaaacacttattttcccggcgcatactggccatgactttatcggcggccatggtgctgggaggggctccgtttgcggcgatgggtaagacagacattggcgggggcggagaaattacggaatttgactcattgccgtcatggatggcaaatcaggaggtggaggttggtgctgatctttcggatgtaaagctgccggatacgcttaccgccacagtgcggttagaaatccccataaaggatagggattcagaagaatcggagcaggaagaaaacataggagaggatccggctgaggaggcccctgccgaggcaactcccagctcggcgattcaaatatgtaagacacaggaagatccaaaagggatagaaattgttgaaaccgctgtttccatccccgtaacatgggaagctgaaccggaatttgacggcgagacaccgggcagctatgtttttgcacctgagctgacgcgggaatacacgctgtccggggacgcagagattccggtaattaccgtgacagtaaaaaaatccgcaatttcggtcaggactgcgggggcaatgatgacactggcaagcggaaccggctggtcgctggatgaggacggtacgcttacgatttcaagcgatatgggtatgtcaggctgcagtggatacttattcaaccatacggcagatgcagcgcgggtaaaagaagttattattgaagacgacgtaacaaaaatcagtgcattttatggctgtacaaatatgacacaaataaccatccccgatacggtgacaagcattgggcagcaggcatttagagactgtgcctctctggaaagcgtcgcccttcctccattgctgacaacgattgaagtgcagatgtttcaggggtgcagttctcttagcagtattactattccccaatcagtaacccgtattggcaattatgcctttgacggctgttcttcactgacgcagatcaccattccggattctgtaaaggaggttaatgtgtgtgccttttccggctgtaccgggctgactgaggttacttttgaaggtgaagtgccgccaacaatagggcctgatatcttttacaactgccccaagcttgaggcaatttatgtgccggctgacagtacggacacatacaagacggcagcaaatatgttaagctatgcaagtaagattaatcctatcgtcattgataccggatggacgctggatgacgacggaaagctgacgattaaaaacgatgcgggcatggcaaactggagttccatctacgtgtttgatgtagtcagaagtgcggtaaaaacagttgaaattctcagtggtgtgacaaacgttgataataaggcattttataattgcacttcattgacggaagttgaaatccccaacagtgtaaaaagcattgggtttaatgctttttacaactgcagctcattgacaaccattgaaattccaggcagtgtgacaaagatttccgagtatgtatttgccacatgcggagcattgcaaacggtaacatttgaaggtgcgactcctccggcgacaggcactcaaattttttatggctgcagtaatcttgaagtgatttacgtaccggcaggcagtaagggcgcctataaggccattccaaaccttggtatatacgagcaattgatttttgaactgaagacggcagtaagcaacacatccggtacgggaagtgtgacctacaacggcaccctcatagaccttacttcagtatccggtttgttcattgtagattctaacgctggtgcaagaacctatagggttgaatccggcggtaccggtacaggaacaatttcaggaagcagcctcactgtcactagggcaggaataatcagaatcggtctggaaacagcggagactgatacacatcaggccggttccatggtaattgctacgcttactgtgaccaaaggaatacagagtgccccttcaggacttggtaaggcggatacaacgatttatgggggaagcgacggaaaaatcactggtctggccgccaacgcgaattatgagtataaacggaacggcggttcctattccaaagcagcttccaatgctgccggtgaaattaccggactgagtgcaggctcctatgcagtgcgtttcacagcaaatgatctgtacaatgcaagcccggattcgacggagatcataattggagaagttgtccggcagagcagtgcaaaggatgtgacaggagttacttctccaggcagcgccgcgatcagcggcacgaccattgccgcaaccgttgcaaacagcgtaaccagcctgaccgtaactcttacggtgagcgcaaatgcgacatggaagctgtacagtgatgccggctgccagaatgaaatctcaaataaaaccatgaccctgaacgcaaactcaaatacggcctatgtgaaggtgagggcacaggatggtacaacacaggtttataccttcaccatcactcgccagagcagttccggagaaagctctcacaacaatggctctggtggaagcgacttcagtggaagctcttcttccgtgtcatccgttaaacccacagcgccagttaccggtaccacggaaaatatggccaccgtggacagtaacggcaatgccagtacaactctgacagataaaaacatcacagattccattgccgccgctgcggcaaatgccgcaaagcaaggcaagaacgccggagagattacggttttagtccatgtttccatgagtggactggatgcggacaccgttacggtgaatctgcctgaaacgacccagcagcagatcatcagtaataaaattgccgctgtagagctgaccatcgaccgcccggatattgtcatgggactgaacaatgaggcaattactgaaattaacagacaggccaacacagacgttcagctgaccgcggcaaaaatagacagtgcaaccctgggaacagcggcaaagaaggccatcggcagccgtccggtttttgaattcaaggcaagctatcaagggggtatgggagctgtgacggacttcggcaacggaaccgtttatgtgagtctcccgtatacaccggcccaaaacgagaaaatcggctatttatatgcagtgtatgtggatgataaaggaattgtcagccgtgttcccggttcagcctatgatgtcaacagccaaagcattatttttgccaccaatcatttttctgtatatggagtcagctacactgaccccaccgctcagtttactgatgtttcctctcattgggcaaaggacagcattgactatgtggcgggacggggattgctgaccgaaacttcaaaagatacgttttctcccgatgctgccatgacgcgggggatgctggttacagctctcggaacgcttgctggcgtggaagaagaaaattacataaccaacagcttcaccgacgttaaggcggacagtatctgccgcccttatattgaatgggcgtacagcaagggtatcattcaagatgtgggcaacagcaagtttgcacctgacagggcggtgacccgtgaagaaaccgcagcgatccttgcaaactatgaaacagcaaccggctgtactatgccggcaatccgcgaagccgtggcttatgcggacgcatctgcaattggaaccagctatcgttctgcggttacagccatgcagcagaaaggcattatgatgggcggcaaggacaataaatttaatcccaagtccagtgtcacacgtgcagagttttcctccatgctgcaccggtatatcaaactgactattaatcctgcaactgcccagggctgggcgctgaacgatgccggacagtatttgtactacaaagatggaaaagccctcaccggttttagggagcttggtataaatgggaacaacaagacctattattttgccgaagacggcatcatggcagctggaaagtggctccagatcgacggcagatggtattacctcaatgctgaaggctgccttgaaaaaagtaccagagttggcgaatatgaggtagatgaaaacggtgtatggaaaacaacataaggaaagcaaaaagtaaacttatcaaaagtcggggctaaagttaagagtctatggagcttagccctatgattgtccagctatgggaaacaaaggagcttgccttctttcaacagagagcgggctcctttcagttttcaaagaagcggaggtgatggatacggattttatatttaaagagaatcattacagattattgtttgaaaacagcatggatgccatattaattactacagtgtccggtgaaatttgccgggcaaacccggaagcctgcagactatttgaaaaaaccgaagaagaattatgccgtggcggccgtgcggcgattgttgatttgggcgatccgaaggtagctcttgcaatgagagaaagaaacaagctgggatcaacaagagtggagctgacattcataaaaagcaatggaagtaagtttctggcagaatgtacgtcggtaatctttaaagacgaagaaggatttgctcttatcgcaatgaccttccgagatatcactacctataagcatagcgtgggaaatcttataagaagcaatgaagaaattatttttctggcaacttttgattatctgacgggggcttttaaccggggcagttttattcagaaattaaaagcagagatagagcgggcgcatttcggaaagatcgcaatgtccttacttttgattgatatagattattttaaacagatcaatgaccagcatggccatcttggcggggatattatcctcaagcattttacggagtgtgcacagtccagactgcgtttccgtgattttctaggtagacttgggggcgatgagtttgtggtatgtcttgcagatacggtgttgccggaggcagcaggcattgccgaacaactgagaatggctgtggaagagctaaatatttattataattccactctgatcagaatcacaatcagcattggagttgcccaatacaagttagaaatgggaatggatacagatgccattatctcaaaagcggatgaatgtctttaccgggcaaaagcaaaccggaactgcatagtaagtgaagaataataggatagaagatttcagcaatttgtgagcgggtattcgtaattaaaaagacaggggtaattttttaatgcaagaatttggggttatgtttttcaaaacgaaaggcatggcctttttattttgccgatataaatggcctggacacacttttgtttgtcagtaatctgaggcgatatgttcctttagagggggcataccgctttttttccttaaaatatttgaagtgtacataatgtctaaataaagtgaagatatatcttgaaaattatagaaaaataaggagttatgtaagggactgttaacaggaaactaacaaaatgctaaaataaaacttgatattagaataaatataaggtaatatattaagcataagttaaatataaattaagtaacaaaagttaacaaataaagggagggtaattgctgagagggggtattttgtgaaaaaaggccaaaaaaagcagacagaagaaaacagatacagcatgagtatggagaagcgattgaaaaaaaattggcagctatatatatttttgctgcctgcatttgctggattgattttattttcctatgttcccatgtatggaatccagcttgcatttcgggactataaccccttaagaggaatactggggagcccatgggtgggttttgaaaattttaccagattttttcattcaccacagtttcaaaatcttttgattaatacactgtccatcagtttttattccttgattgtgggatttcccattcctattatcctggcattgggattaaattatgtggcaaatttgagatttaaaaaggcagtacaatctattacatatgcaccgtattttatttccactgtagttctggtcggtattttaaatatttttctttccacggatggcggcttgatcaatcagctggtgaagctctttggccgggaacctgtattatttatggggcagtcaaggttctggcgtcatatttatgtctggtccggtgtctggcagagcatgggatggaatgcagttatttatatcgcaacacttgcaggagtaagcgctgagctgcatgaagcggcaaccatagacggtgcaaccaagcttcagagagttttcaggatcgacttgcccatgattttacctacaatagtcattactttaattttaagctgcggttcaataatggggattggatttgagaaagcttatctgatgcagaatcctttgaatctgggagtatcagaaattatatctacctatatctataagatcggtctggtaaacagtgagtatggattttctacggcggttggtctttttaactctgtggtaaattgcattgtactgcttactgtgaatcaagttgcaaaacgtatgtcaaagacgtcgttatggtagggggaagaaatgatagaaaaagtatttggaaaacaatttgtaaatcaaagccgggcaaataaggtgtttgatattgcaaaccatatcatattatttacgctgatgatgattgtgttgtatcccctgtattttattgtaatttcctcatttagttccccgattgccgttgcaggcggcgaagtgattctgtttccaaaaggttttaatatggacggatataaggagatttttaaatataaggacatttggacagggtatcgcaattccattatttacacggctgtgggtacaacagtaaacctggtttctacaattcctgccgcatttgcattttccagaagggatttgccgggaatcaaaccgctcatgctgttatttgtatttaccatgttttttgggggaggcttgattcccactttcctcttggtacaggcgcttcatatggataataccatatgggctctggtactccctggggccgtcggggtgtataacctgattgtggcgagaaccttctttgaacagagcattccggaagaactgtatgaggcctccgttgtggatggatgtgattattttaaatattttttccgcattgtgcttccaatttccaagccgattatagcagtaatgacgctgatttatgcagtgggacactggaattcctatttcagcgcgctgatttatctggtggacagaagcaagtttcctcttcaggtgattctccgtgaaatattaattcaacagcagcaggtggccggaaacagcgctatgacttttgaagcagtggagcagcagcgttacctggcagaaatgataaagtatggagtgattgtagtggcttctttaccggcactgtgtatgtacccctttgttcagaagcattttgtcaaaggaatgatgataggggcagtaaagggataagtaataaatctgaatgaaaaggatgaaaggaagggtgaaaatgaaaaaaagcagggtcattgcctcggctttagttgctgctatggcatctcttgcagtgtcagggtgcggaaaacaagcagaggaagcaaacgcaataacagtagacgtgaagaaaacagggtatcccgttgtggatgagccaattcacatcaaagcaattggttttggaaaacccggcaacggagagtggaatgattatcccattttccaggatatttccaggcaaacaaatgtattcgtagattaccagaccataagcggcgacggagcggatgaaaagctgaatctggcgctggcgtcaaaaaacttaccggatgccgtattctccggtttgtcttcccaaaagattctttcttatgcggaaaaaggaatcattcgtccgctggaggaccttatggaagattatgcgcccaatattaagcgtgtgttagatgaaaacccggagatccgaaaagcaattacgtttccggatggccatatttatgcaattccgtcaatcaatgaagaccagaagccggtgcagtctaccacgttaaatattaacaagacctggctggatcagctgggactggagattccaaagacaacggctgaatttgaagaggtgcttcgtgcatttaagactatggctcctgacggagatggaaaaaataacgtaattccatttacctatgagccaaagacaccttataacatctggaatggtgacgcaggtttttccggatcgtttgggattacagacagttcttcctatttgatgagatcggaagatgaatttttatttacccccatacaggaagggtataaggattatatcaagtggacggccaggctctatgaagagggattgattgatgtggaactgtttactcaggaccataaccagtacatgtcgaaaatcggttccaaccgtgtgggtgtataccttactaacggaccgttggagacagatggggcagaatatattgccattgaaccattaaaagggccgaatggagatcagttctggggttctcttgatttcagcattgataaaaacagaggcgtgatcaccacctccaacccatatccggaagccaccatgagatatatggattccttctttgagacagaaaactcactgcgcttaaggtttggaaactatttaaagtcggctggagatcagtatgagctgatgccatccatccccggaaagaattctgaagcgccggaatcctatgtagcaacaaatttaagttcagaaattatggatacatatattattgaaaccaaaagcataaaagagaaaaaagaaagaatagagctttattctaaatatctggctcctccggttccgttaattaacttgacaatagaagaatcaaagcagatttcctccctgtttgtggacattcaaaagattgtggatgagaataaggcgagatggactaccaatcagtctgacattgacaaggattgggatggctacctggagtctttaaacaatgtggggttggataagtatatggaaatttataatgcggccttggcacggtacttaagcaattaataaacagctgtgggaggaaaagaatgaaacagaaaaacctggtgattggatatatagaaacccaaaatcttttcctgttaagagacagggacattcaatgtctggatgtaataaatctggcatttgccgcggtcaaagatcacggggtaacatgggatcccatggggcactcagacatactcaaacgggcaaaggtcctgaatccggatttaaaaattgtattgtcaatagggggctggggatgcggcggtttttccgaagcagcttctacgaaagagggcagagaggtatttgccgcatcagcggccgcacttatgaaagaatacaacttagacgggcttgacattgactgggaatatccctgtgttggtattgcagggattgcctgttctgacaatgataaggaaaactttactctgcttataaaaaggctgagggaggaacttgatgttattacagacagagtttgtacattatccattgcggcaggcggagattcttattatctccgctgtacgcagatggatcagattgtacagtatctggattatgtgatgctcatgacctatgatctaaggggcggtttttcagtccagacagggcatcatacgaatttatatacgagtaatgcagatttatctgcagccagcacggataatgcggtaagaatatttgaacaggcaggggttgctaaggaaaagcttgttatcggcgcggccttttattccagaatctgggaaggagtgcctgacaggaacaggggacttgtacagatggcagaaaccaccggagggtatgggccggattatggcgtactggttaaagattatattgataaaaacggatacacaagatattgggatgaggaagcaaaggcgccttatttatttaatggccgtagctttatcagctacgatgataaggaatctatccaatataaaatcaattatatcaaggaccggaaactggcaggcatcatgttctgggagtacagtcaggacggcacccatacattgatcccactaatggctgaaaaattaaaggcggatgatcatgaataattgttggtttcataaggcaaagcttggaatatttatacactacgggatttatgcagtcaacggaattggggaatcctggtccttttacaatggaaccatcagctatgaagactatatgaaacagctggatggattttatgcggataaattccatgtgtctgcctggggagatctgattgagcgctcaggggcgaaatacgctgtcctgactgcaaaacatcatgatggtgtggcattatttgataccagattcagtgatttaagcgtggtaaaaaagacacctgcaaaacgggatattgtaaaagaatatgcagaagaaatgaaaaagcgcggcattcatcttgggttttattattcactcattgactggtcacataaagattacgccagcgtgtatgcggctgggaaggttcctgataatccaaaggaaataaacccttttacatctcctgttgacggaaaagaagacccggaaaaatggcggcgttttttagattttaataacaatcagttaagagagctgcttaccaattacggaaaggtagatttactctggtttgacggagattgggaacgcagcgccggccaatggggctgccgggatttaaggattatttaaaatcattgaatccggatctgatcatcaactccagactgcaaggttatggggactataagacgccggaacagggaatccccattacaaggccggagggagactgggagttttgtactacgattaacggttcctggggataccaaccaagggacaatcaatacaaatctttaagccagatcctacgtatattttgcgactgcatttccatgggcggaaatatgctgcttgatatcggaccgcgccaggacgggaccatagattcccggcaggaggcaattttatcagggcttggctcctggatacgggagcatgaggaggctgtatatcaaacagatgaagggattgggacctgctattatcttggcggaagtaccatatctgctgacagggaaactttatatctgtttgtgtacgataatccaaaggaatccatctgcttaaaggggctgtgcaatcttataaagaaaattaccgttctgcattcaggcaaagagctgccgcatgaaatccatggcggagttccctggtttgaaattccgggaaccacctggatcaggctgacagcggatgactgccacgatctggtgactgtggtaaaagttgaactggaaggaaaaattaagatgtatggcagttccggggaagcagtaactcataatgaaacctgataaaatacagaatgagcatgatgcagatgcagttcagcgaaaagaatggatgaaaaggtggcagaatgccgcggccaaagataaaactgcaagatttacaagggccgttgatcatgtgaaaattggtgaattacttctgaaaggcgtagaataatctggaaatatatattataatgagtgaaatgaacaaataataatagcgcagaggtcgagaaggtgaaaaggaaaaaaaacgtaacgatgcaggatattgcggattatttgtctatcagtaaagtaaccgtatccaaggctttaaatggaaaagacggagttggaagggaattaaaagaaaaaatcatagcagtcagcaaagagttgaattataagcttccggaaagttcaaagatatgttccggaagttcaaaaaatattgctgtttttatgaaagaaaagtttgctcatggagaagccgggttttatttaaagttttatcagaggatttccatggaattaaacgaacgtggttatctggctcatttgtttccccttacccctaaagacgacaggaaaggaaagctgcttccgctgctggaaaagtatgacatagccggagttatttttctgggtgatattgaaaaaacgtttctggctgaggtgaaacagacacagcttccctgtgttctggcagatacgtatgataatgattttgatatagactgcgtgatcacagaaagcatgtacagcatgtgtgaactgacgacgtatttgatgaagtgcggccataaaaacattggatttgtgggtacgttcacagcgacgaacagcattatggaccggtatcttggttattgccgtgcgcatttgaaagcaggacttccgatttgcgatgagtggatcatcggagaccggaatatggaggatgaaaatgtggagtttatgctgccggagcatatgcctactgcttttgtctgcaattgtgatgatacagcgtaccagtttatccgtatgttaaaggaaaaggggtaccgggtgccggaagacatttccattgtaagctttgacaatgatatttatgcggagctttgtgttcctaagctgactacggcggaggtgaatattaatcagatggccggtaaatccgttgagttgatttgtgaaaaaatagaacaggagaatgcccccagcagaggagttacctttgtaaatgcggcaattatttatagagattccgtaagaaatatggagtcataatgaatggaaacaccctttggtgatatattttacttcattgcttgggatttcttttagatggaaaggtttctgcagcatattatttaaaagtatgagagacagcctgaatggattgcagccatttaagcggtctctctcttcattagaattacattttatatagacctttgcattttacagaaattgttctgattccacttgacttggagttagctccaagtgataggatatgtacagaacatatgaggaaaggaaaatgcggcatgaataaaacagtggctttgagcttcagcttacaagccatgctgcagaaaacgttaagaaatcaataaggaggctaaaaaatggaatatgtaaaactcggaaattcgaacattcaggtttcccgcttttgcgttggctgcatgagctttggtgatcctgccagcaaaatgcacgattggacgctgaatccgcaggaaagcgaaacgattataaggcatgctcttgatctgggtataaatttctttgacaccgccaacacttattcggccggcaccagtgaagagtaccttggccgggctatacggaacaatgcggcccgtgacaaagtggtgctggcctcaaaggtctattttaacgaggggcatctttccaaagaggcaattctgcgagaaattgacggtacgcttaaacggctgggaaccgattatctggatctttatatcattcaccgttttgactatggaacccccatagaagaaaccatggagacccttaacagcctggtcacagcgggcaaggtgagagccctcggcgcttctgctatgtatggatatcaattctacaacatgcagcttgccgctgaaagaaacggctggacacccttcgtctccatgcagaaccactacaatctgctctaccgcgaggacgagcgtgaattaattcccatatgcaatcagcagaacgtcgcatgtacgccttacagccctcttgcggcaggcagactttcccggcttgaatggaaaaccgatacaaaccgcagcaagaccgataaaacggcgatttccaaatacgatggaacacaggagactgattacaaaatcgtattgcgtgtcaatgaaattgcagagaaatataacgttaccatgacccaggttgcccttgcctggcagtttgcaaagggcgttgcggcccccatcatcggtgccactaaggcaaaatattttgatgatgcggtgggcgccttcaatatcaggctggcagatgacgatgtatcctatcttgaagaactgtatgttccccataaggttgttggcgcgctctgattgaaataaaaggaatgaacacagggggatacattcttttcaggcagtgtgttttggtgactgatataaaaaataaaaggagaaatcagaatgaatagttttatttatgatataccaacaaaagtttattttggagaaaatcagctttcccatcttgggccggaactttcccgtttcggcaagcgcgtgctgctgacctatggcggtggatccattaaaaagatagggttgtatgataaagtaacagcagaaatcaaggccgcaggtctccagctgtttgagctggatggcattgcacccaacccgcacattgattccgtgcgcaagggtgcggagatctgtaaaagagaaaagatcgatgttttgcttgctgtaggcgggggttctacattggatgcgacaaaattcatggcagccggcgcttgtgtggattttgacccgtggaagtttctaagtgaatgggcgccaattgaaaaagcgctgccggttgttaccattctcacacttgcagccactggctcggaaatggactgcggaggagtcatcagcaatccaaaaacccaggacaaaatcggccggatggagtttcccatgctcccaaaagtctctttcctggatcctgtcaacacctatacggtcaatccatatcagactgcctgcggagcggctgatatgatgtcacatattatggaagtctattttaacatggatcaggatctgcagatgctggatgggattatggaagtgttgatgaaaaccatcatcagatatgctcctgtcgccatggagcagcctgacaattacgaggcccgtgccaatctgatgtgggcaagctcctgggcgattaacggatttgtgaacggcggcaagcgccaggcatggagctgccatcccatggagcatgagctttccgctatatacgatatcactcacggtctgggcctggccattctcacaccgcgctggatgaaatatacgctggatgaaactacggcatctaaattttatcagttcggcgtcaacgtgtttggcatcgatgcatctcagccgcatatggaggcagcaaagaaaagtattgagcttttaggcgatttcttcttccggacgctggggctgaaaagcagcctccacgaaatcggcatagacgataaaaactttgagattatggcaaaaaaagcctgcaacggcgggacgctgcccggctttaaacctttgaatcaacaggatattgaaaatatttttaaaatgtgtttaagcagctttaatggatagcagaaagtcataccggcgaagaacaggataaatataagtaaacagggatgtgaaaatcaatgactattgcagaagtggcaaaaaaacatggacttacccctgatacgctgcgctattatgagcgtatcggcctgctgcctaaagttgcacgaaccgcgggcggtatccgggactattctgatgaggattgccgatgggtagagtatatcaaatgtatgcgcttagcaggagtttctgtggaaacccttgtggaatacgttaccctttttcatcagggcagtgataccgttaccgcccggaaaaagctccttctggaacagagggaacaaattgtctcgaaaattgaggaattaaatgcagttctggaaagactggattggaagctggatggttatgaagaacggatgtccaaatgtgaagagaacttgaaataattatactaaaaaaagtccgcctgccgtgatccttaagcagaatgatttttcccggaattcccaactccggccatctgaatgctgtttaagggttacaggtaatgattaagcaattgcctggcatgttgctttatataatcaattacttcatatggctctactacttttgcatctttgcccaaacggaaaaaatactctgatataaacggtatctcactttgatcaacttccatatcgacaaatccgtttccatcttcggttaaaacaatatcaggctcaagccaaggttcactctgacattgccgcaccccttcccttgttaatttgacatggagcttaaccggtgtcttaacaatatgatcggtcagccagttctctaaatccgccattacaggaaatactttctctgaattttcaaaggataagatcctgtcgaccctgaataaccgtattgtttgatgctccatatcaaaggcaggcatgtaccaaaatccatcggccgcatatacgccaatgggtttgacttcctttactttattctctgttttggaataatattcaattattacaatatggtcatttattgatgcttcaataatttcctttaaatatggagaaggaacactcctttttttgctccaaaataataacacagaatccaaacggtcagtttttcttttgatatcatccggaagacttgagtaaagttttcttgatactgaatcaatgtttatgctgaacggtaatgattgaaaatatttgagtgaccggaatgcaaagaatatagcaaaagcttcctcttcatcaaataggataggtgggagcgttctgcttttcagagtccgatagcccccatttcgcccctgttctgtataaataggaatgcccatttcacttaactccatcaggtagcggtgagctgttctgagtgatacatgaaactcataagcgacatcctgggccgtaaagttccgttttgtattcacatacatgattaaatcaaacagcaattttgtttttgacatcgtcggactcctttcattttaataattataaaaataaaacatgtcagtaattggcatgtttttattatatattaatatttgtaagaaatcaatcttacgatgttgatgattattatatgacaggaggcagtatatgaatattgttttaggggctacaggacagatagggttcatgttggcaaataacctttttaagaaaggccggccggtacgggctgttgttagagacgagacaaaagcccaggaattaaaaaagatggggattgaagtttttgtcgcagattatcatgataaagaagcattaataaaggcttttcataatggcaaaaccgcttttttattaacgcctgaaaatccagccgctgaaaatcaactggaggaagtacgactggtgatcgataattatcgggaggccataaaggcctctggcattcaaaaaattgttggtctgtcttctatgggggctcagcatgaatcaggtacaggaaatctgatcgcatcttacttattggaacatgcatttgatggacttcatatggagcagatttttgtcagacctgcatattactatagcaattggatgggaaatctggaattaataagaacgcaggggatcttgccgaccttttttccgttagaaatgaaattatcaatgatttctcccattgatgttgcagagtttttagctgatgtcatgattcgggaagcgccccaggaacgaatatacgaagtctgtggcccttgtgattatagctccctggatatagcaggaatatttgggaaagtattcaataaggaggttgcattacagcaaatttcacctgatgaatggaaatgtacgttagagcaagcgggtttttcatcggatgggataataaattttatgcatatgacaaaggctgtaattgatggaaagacaaatagtgatacctctggtccggttcatctttttatggattttcaaacatttctggagcgaaccgtgtgatatgtaaataatctgcttatcatcctgcataaatgaaggagttacaaaagcttcggatttgctgtaaccaggcgttgtgatgaacttcaaaagactccatatgatcataaatccaaacaatttacataacagcattattttttgcataatattaaataaattatccactggaacagggaaaatggtgatatatgcaaagggttctggatgaaaattattatgacctgattgctgaaaattcaatagatccgattcgcaatgaagatgttaatatgactctattgaacgaggcacatcacatattgcatgtaagtacacatgaaataaatatctgtgatcaaagacaggttccttattattctttacctgaattatttacaccgatatcgatcattgacagaggtaacgcagatattgaaagttttcggtatcattctgagcctgctttctatggtaaagatattattattggtattttaagcacaggaattgattatcagcatccagtatttcttaatgctgataagactacttgtattatttctatgtgggatcagtcagagcaaggcggtgttgttcctgaggggtttacctttggcagtgaatataccagagacatgattaatcaagcattggtatcagaagatccattgtctgtagtcccatccagggatataaatggacatggaacagctattgccagcattattgctggcagacctgagtcaaatcagtcttttagcggtattgtaccagaatctgaacttgtaattgtaaaactaaaggaagccaagcaaaatcttaaacaactgttttttgttccggatgatttgctgtgctttcaagagactgatctaatgcttggaataaggtatttagttactgtatctgaaaacctaaaacgtcctttagttatatgcattgcattggagagcaaccaaggtggtcatgatggaatcagccctatcagtacttatttaaatattattgcaggattgcctaatataggagtttgtattgcagcaggggatgggggaaacaaagaaaggcattactttaacagcaccttttcccagccttattataatgacttccaattaaatgtagggagcagtgacaagttatttttcatggaaatttggccatatgcgccaagcaccttatctattgaggttatatcacctttaggggagtctacagaatcagttgacccttcactggtttgtaaagagtttacttttgagcaaagtcagagtattctcctgattaataattttgtttttgagagtggaggcaggaatccattaattttaatacgttttagaaatccttatccaggagtttggcattttcgggctttaagcatagaaaacacaccattttcttttcatacatggttaccagctggaaatctgatctctaacgagacctttttctttgagtcagatccggataccactgtatcttcaccaggaactactacgagtcccataactgttactgcctataatcaagttaataggagtatattgattgaatcgtcaagaggttataccagaataggcgaagttaagcccgatatagcagcacctggttaccagataccgtgtgcagttccagagagccagtatggagtgatcagcggaactggcgcggctgtcggatatgcagcgggagctattgccatagccttggagtgggctggtataaaaagaaattttgtcaatattaatgggaatcaaatcagaggattattaacttttaacgctctgcgggattctgatgtaatttatccaaataaaatatggggatatggaatattagatattgaaaatttattgaatatgcttttaagcacatgataacaatggaaggttatttccaaccaggttaataatatcgcagaaagaggaggcataaaagctgtaaaaattatgagaaaatttttaaagaatagaattcaaatatgtaatacagctttacaatagtgaataagaagataagataaatcataggcgtggatccggtacccggggcacgcctaaaaatgtgctgcgcgatttgcatgcggcatgttaataataaaaccagtcataatgcccagattaattaaactaaaataaatgccgctctcatatgagttgcagcaatagcgggataattgaagatatgaactctggattaattccgtaattcccttatataatataattttctggcttaaattggaaaccaatcatagaatgcaattattaaatgaatggcatactaaaaatagttttataataaaaggaggcaaaccatgagcagagataattctaaaaaaagcacaaaaaatcataaaaaagaagatggtacttttcattcaaaacatattaatcacaacccgcaagcagaaagcgcgcgagccgtatttggattgaaagcagataattcaaaagataaagaatcttagactttaaatttcactgaaatatctcgcgttcagccgaaaaagcagacaagtatgaatctatttccatatatatggaaatgggatcaatgagatttaataggtttataaaggaggttttaaacatgtctaattatactggtgtagttaaatggtttgataacgaaagaggctatggctttatctcaaccaacgaaggccaggatgttttcgtacatcattcacaagtcaaagaaaagactcataataaagatttacacgagggcgagtctgttaattttgacgttaggcaagatgaaaaaggcttatgcgctttaaatgttcagaaaatataacttatccgaacttgcaacgcaagtgaggataaaggaacgttctttgccccgtccatccgattatgaaaacatctttttgttttcataatataattaaaattgtaaaggagttatcttatgaacaaaattcattatgatatatcaggaatacagaattcggagattaaaactcagcttaaaaatgcattagataaaatagaaggaatttcaatggttaatattgatgtggcaagaggttccattgaagtcggatataatgaatcaacggacgaaaattcgattaaatcttgtattgaaaacgttggatgtagtattataagctaatttggcgaattttgagaatagagtctgtgaaaaagactctataatttatgctgacttccataattctctatgccaacataaaaaatatactgccacgtagcaggcagtttgtactatataagagtagggaaaaatgtccctattcttatttttttgttacgataagttcaatttgggggaagaggagaggtgcggacaaaaaactttttatccgcaccctcccccaaaatcagattttattttatcagcattgcccttttttatcaatagaacaaaaagagacaggactctccattttttcggcttcagcaggaatagttacatacttatcgatctcaaaagttttttcgccattttccaatataaaaaacggtattcctattcttcctgattccttaacttcctggaaaatactatggttatcccggtaagctaaaaattcctttaaagtagctgtgtcaccaataatgttcttgtattcaaactcaatatcactaagtactgttaagctttttttagccttaacgcaatcaggacaaatttccgcccatacatggttactttcatatttacctcccattctgcagcaatagatagcgcttaatattattttgatactacttttattataatctcacttctttgttaagtcaatctgagcgacctattctaaaccgtccggatattctatacttttaagtgaataattcaaaacactgttttgccttggttaatcgagttgatttcattcaagttgcaaactttatttataatagtgtataattgagaggcaattataatgacaaagattgctgatgattaaagaaagcagcgaaacgaagggccacccgatggtgcgtggggcgctgtgccccttggtcattgcgaatatccgtttgactgaaagagagaatgggattatgaatcaattttttactcaggtatatgatgttgtggagagaattccccgcggtaaggtgatttcatacggacaaatagcgtatatgcttggaaggcctcgtgctgcgcgggaggttgggcgggcaatgcgtttttgcccggaatatttgccgtggcagcgtgtggtaatggctgacggctccattgcaggcggcggttttccggaaatccgtaaggacatgttggaaaacgaaggagtaccctttctcccggatggacgcgtcgatatggcagcctgcctgtggaaaggagaaagagtgtaagtccctgttttgcttcatcaccggtgtaaataagccgggacggcagaggtctatccgatctcttattccagcctatagcgaacttcatctgacgcccggttcatggtgccttttggatcgtggccaaaaagccactcatcgtgaatttcttttggtaaaatcaccggcatccgatcgtgaataaatgagatgccggaccaggctggacgtgtcagaataacaaaaagcgagtctcctgttttagcgtctctcctcgatagcccggcaagccatacaggacgattgtcaggagccgccagggcatattttatcttttttgagcctcgtttttcccattcaaagtaccagcttgccggtatcaggcagcgtccttccatcatggggtagcgaaacatgtttttttccgccgctgtttcgcttcgggcgttaatgacttcccctttattgtcataccttggaaaaccccagcgcattgccgtcatggttccgtttggcgacaaaacaggcacagtgtttgttggatatatttctccggttttaacggtcgcttttttttcgacttctgcaataatggaattcagttcaatattgtctatttcaatataatatctgccgcacatgttattcgatcacctttcctgttgctgaatcatctggtagtattgcacatgttttaatattatattaccataacccatttacatgagtccatgaaatatgtcaatttaaattcctttaataattgcaggaaaggagaaaatattatcagatgacggcaatgttttgtctaaggccccaactcctggtgggaatttgatttaacaattttcaaacatttcataaataactcacacatattccgccgctatgataaaaacatcaaattgataagctcaataacattaatttttaagcggaggattcattatggataatcaaagcaatgaaaaaaatatagtttaccttgtgacagggattgccggcaatctgggaagcagtgtagcggcaaggcttctggaagatggtaaaaaagtgcgcggccttgttttaaagggcgatcctgcggctgcacgtgtgccgggggaagttgagatatgcattggcgacgtgactgatacagagagtctggaacgtttttttactggaaaaggatgaagcgatgacctatatgaaatacaatgcaataaaacgtttgggcaggccggaagaaattgctcaactgtatgctgccgtttcagatgaacggctgggatatttaacaggtgctgacattctgtgtgacggaggatgtgtagccagcggatgcagtccgtttaagcgttcatgatatagcggatgaaacagaatcacggactatactattagaaatagaaaccagtttgcacactgtttgcgtttatgccatgaagctccggtaaaaactttgtaactgtatgaattcaaaaacgttgtggtacatggttttggcagtaaggcggtattgttatgatggcaggcaaaaaatatcggatatccgtatccgggattagggaaggaagtactttttcctattgtaaaagggatttgatcgtgttaatattgcattattcttataaacaatgagccacaggtgtgaaaacctgtggctttggaccttgtttccaggggaaattgatagaaccaacgccaggaggaaatatatgcagattcaatacgaatcagcctttaaaggcttagagaatcatataattgaagtcataaaagaagagcagattaaaattggttatagaagcgaaataataagattgtattaccccattgaatcgatttgtaatctgttaggtacatcttatactgtcacggagttgtttaaggttttggatcaattctgtgaatttgtaaaggaacggttaggaatagtggagtactccaatacagaaacaagattttgctttaccattcctccaaagggagttgactatgttcatgaaagcattgatgaaaactattttttaagagattttattgaaaaaataagcatacatgattgttcactggaggatctgctgaatatattttataaatactcaagtaatgttgtttgtgaaaagatgaacaatggtgaatttgattacttaatatattttacagatgggaagccggatgcttacaggtattgtataaaatttgaagactgccatactatttatcaccgatttattaaagccgattatgagaatttcggtttttaattttctgccttttttcaaatggctcaaaacagttttttgctcaggattaaaattttagaaaaaatgtgtatcaggacattggtttgattaatatataatcatataatagttattagatgtattggagattaagcttggctgattattattcatatttgggctataaagaagtatgccaacaggttccgatccagttccctccacagcatcagtccgtacaaccaggattggaaacacttatggttccgaaacctgtctttgacaatccagactatattggaacaggtaaactggaagataaagtggcattggtaacgggaggagacagcggaattggaagagctgtgtctttggcatttgcaaaggaaggcgctgatgtatgcatcgtttattatgacgagcatgatgatgcgcaaataacgaaatcctatgtagaagctcagggaagaaaatgtcttttgatctcaggagatgtacgggacgaattgttttgtcaaaacgcagtatccgaaaccgtttcatccttaggcagacttgacgtcctggtaaataatgcaggtgtgcagtttccgcaagacggtatagagaacattgccgttgagcagatggtacttacctttgaagtgaattttttcggtattttcattatgacaaaagcagtcctgccccatttaaaggacggcagcaccataattaatacaacatccgttactgcttatgctgggaatgaccagttgattgattattccagcacaaaaggagcaattgtcagcttcacccgatcaatggcccgttccctggtgtctagaggcattcgggtaaatgcagttgcaccaggtccaatctggacgccgcttcagccttccagctggccggccgactacattcccacgtttggttccaacactcccatgaaaagagcagggcagccggtagagcttgccccgacctacgtatatcttgcaagtaacgattcctcatttgtcacaggtcaggtcctccatgtggacggcgggcaatccatgcaatcataaagaaacacagggaaaacataaaatagctgcaattccatttttggattgcggctgttttttataattgcccgtttgcctttggcttccatatcccttaccgtggacaggccaaatgaaacgtcaattccattggccccaagaaaggcatgttgaaaatgaatctgctggatttgctggagtccgatcatgccctcaatggatagaaacaatcaaagcattggcggaattcggatcaatcaggcgtgatagatgctgaaacggtctgcctgctgcctgaaagatgtgttggtactatctttacctgccttttttgctatgctatactagagacatcaaaaaaagcgtattttgaactgatgttgggagcttgtattgtcacaggaaggtaaagcatgaaaaaaagtattgcggttattgcattggatccatttgctggaaaagcatatgccaggcaggtgcggtcagtatttggggaacgggccgttgtacgaaactacagcatgatggatggaacggcagcaaatatggaaccctgcgatctttttatgggctcaacggatgcctttgacgccatgggggatccggaccggtatattccgcctgaagcacagcggatggaaattcaggttacttatttaaaggaagctgttcgccgtctggaagagattccaaagggcacgaaggtcctttacgttaatatcactgaggtcatggcaagggaagcagtgacgcagctggaacagctgggaattactcatttaaaatttattctctatgctccgggaagcaaactgactgaaatggcagagattgctgttactccggatgaagagcgctatgtgcccagtggaatttccacaattataaacctgggacagagaacctgctcgtctgatacaatgatagaggctgcattccggcttggttttgacgatttgctggaagaagttgaatttaaacgttatcaggagtcggtttgcaccaatacctactattttgatgagatgtttaaccgttccaggagactggagagccagtttgatattctcatggaagtacttgatcagggagtgatcgctgtaaatgaacatggagaaatctatgcggtcaacaaaaatgctgccgatatcacccgggtgcctgaaaatctcggcatttcaaaggcgggagaggaagtgtttccctatataccgttccggagatgcttagaagagaaaaaggaaacgagtccccaggttgtaagagttgcaggtaatttagtcagcctttacgtgcgcccggtgttaaggcgggatgcctgtgtcggcgcatttgccattttgcagaagtttaatgagatggagcgccgtcagaacgagctgcgggttcaattgatgaaaaaaggccaggggcatagggctaaatattgttttgacgatgtgatcgggcagtctgcccccatattaaagactaaatttattttaaataaaatggccggtacggaatctccggttttgttaattggagaaaccgggaccggtaaggagctgtttgcccactccgttcataacgcatcaaagcgaagggaccagccttttgtggcgatcaactgtgcggctatgccggagaatttattggagagtgagctgttcggttatgaagaaggggcctttacaggagcgaaaaagggaggccgtccgggtctgtttgaattcgcccatcaggggactctgtttttagacgaagtggaaggcatgagcccggccctgcaggtaaagctgctccgtgttttgcaggaacgtgaaattatgcgggtcggcggaaatcaaattatccatgttgacgtgcggatcgtagctgcaaccaatgaagagcttgaacaaaaagtagcggaaggcactttcaggcaggatctttattacagactgaatgccttgccggtgttaatcccgcccttcgggagagagaggaagatgtatttttaattctggacagttttcgaaaagagctggggggaagctttcggctaagtgatgatattaaagaactgttccgggaatatgaatggccgggaaatatacgggagctgcgcaatgttgtggattatttgtgttttaccggtcatacggtaataacaattgatgatctgcctccggtttttcgtatacgtaaaaacagacaggaggtaaacgggatcaaaggggaagagctgaatccacggacttcaacaaagccttcccgatatgaaactatattgcacacacccacccagcaggagcaggtgatcctggaaattctttacgacgcagagcgtagaggacaatccattggacgggaaaaaattctgctggaggcgcagatgcgtgaaataaagttaactcagcctcaggtgcgcaaaatattaggcaggttagaggaaaacggttacgtaactgttacaaaaggcagaggcggaagcaatattaccaaaaagggagttgattggataactaattaacaacccatttaaaacccatttaaaaccaattagccaccaattaataaccaaaaagatgaaaattgcatttctcaccaaaatgttacaagatatagcaaaaaataaacgtagaaaaggtagcgtttgcagatcttttctacgtttttattaatatttttctttaggctgaaaagttggcacacgtgttgctctaatataaaagtataaaatggaaaggagctttatatgaaatacaattttgacaacgtgattgacagaagcaaaaaccgcgcgggaaaatacgatgagaggcagaagaagtttggcaccatggatgtgattccgctttgggttgcagatatggatttccagacagcacagccaatcattgatgcatgtgtggaaaaagccttggaagggatctggggatatacatatcggcctgactcctattttgatgcaatacttggctggcagcttcgcagacatggctggaagattgataaggaaaaggtgagctggagcttaggagttgtacctgcattgtcttccattatcaaggtgtttactaacgagggagactctgttatgattcagactcctgtgtattctgaattctatgatattacagaagcatgggaaagaaaggtggtcgaaaatcagctgattgaacaggagggaggctggaccattgattttgcagatttcgaagagaaagcaaaagatcccaacgtaaaaatctttcttctgtgcagtccccataatcctcttggcatcgtctggaggaaagaacagctggagaagatgtttgaaatttgccgtgccaatgatgtgctgatggtttctgacgaaatacactctgacctggtgtttcatggaaagaaacatattccgacagccatgatatctgacgaagccagagatcatgtcataagctgtatctccggtactaagacatttaatcttgcgggattgcaggcatcaaccaatgttttccccaatctggaaatgaaggctgcctttgataagttctggatgaatttagacattcacaggaacaatgcatttagctcagtggcaatggaagcggcgtttaatgagggagaggagtggttggagcaattgctcccatatctctctgagaactttgattttatcaaagattattgtgagaaatacattccgaaaatcaaacctaatataccggatgccacttatctggtatggctggactgccgggaattggggctggataatgaacagttaagaaagttcatgatcaaggaagcaaagctgggcttaaatgaaggttatacctttggccgcagtctttcaggttttatgaggttaaatgccgcatgctcccgaagcgtgcttgtaaaagccatgaaacagctggaggccgcggtaaaccgtctgtgagataaaaatgatgaaagtcacttaaagtcaaaattatggggtaaaaaggagaagtgaatttatgaataaaagtgatatttggaaaagctatcggttccctattttattggtgttgggaatcttaattgggtcagttttcggattggttgcaggagagaaagctacaattgtgaaacccctcggtgatatttttcttaacctgatgtttacaatcgttgtaccaatggtcctggtttctatttcaagtgcagtgggaagcatggtaaatatgaaacgccttgggagtattttggtaaatctcattattgtttttatcggcaccggcgcagtggcagccgtacttgttctgtttgcagtgaacatttttccgcctgctgcaaacaccacaattgccatgagcgcagcagatgtcggagaagccgcttcggctggtgacatgattgtcggagctcttactgtttcagattttccggatcttttaagccgtcagaacatgcttccgctgatcattttttctgttatgtttggattctgtgtcagtgcatgcggcggtgacgagagtccagttggaaaaatgctaataaacttaaatgatatcatcatgaagatggttaatttgatcatgaagtttgctcccattggcctgggcgcatattttgccaacttagtaggcgagtttggaccgagcctgattggtgattacggccgttccatgatcttgtattatccgctctgcctggtttatgtggtaatattctttccattatattcctatatagcaggcggaaaagaagggattcgccgtatgctgaaatttgttcctactccggcagtgactgcttttgcaactcaaagctcaatggccaccctgccggtgaatctggatgcatgtgacaaaatgggagtcccaaaggatattagggaaattgttcttcccatgggagcaaccatgcatatggatggttcggtgttatccgccattgttaagattgcatttttgtatggagtatttaatcagccgtttaccggtgtgggaacttatgccatgtcaattgttgtagcgattttgtctgcgtttgtattgtcaggagcgccggggggcggcctggtaggtgaaatgttgattgtcggtctttttggttttcctccggaggcatttccgctgattgcaacgttaggttttctgtttgaccctgcagctacctgcttaaattcatctggtgatgctattgcctccatgatggtagccagaatggttgaagggaaaaagtggattaataatcacttaacagggagcagcgaagaattagttgaaaatccggatgttaccgcataaaggaaaggaagaatgaccatgaaagtaacaatcatcggaagtcacttatgtccggacacactgtatgcaatgtataaactgattgatgggaaggctgatgtggacttcaaaaatttgtcagcggatttaaaggacttgaaagcgtatcttgctgcccgtgaaacagagccggcttatgaggcggttaagaaaagcggcggcattgggattccattctttattttagaagacggaacgaaaactttaagcctggctgaagtgctggaaaagctgtaatattcatagaaggtgattggttctgtttttaaatattgagtaataagtctaaggcaattcgttatatgtttagaagtaaaagcaatagcatctgtatgaggaggtatgattatggttttaggtcaggaaaaagtctcattattgaatttacccactcctttggagtatcttaaaaatatctcagaagagttagggattaaattctaccttaagcgcgatgatatgactggtctgggcatgggaggcaataagcttcggaagctggagtatattttaaaggaagcccaggataaaggggcaacgatgcttgttactgaaggcggagtgcaaacaaatcatggacgtttaacagcggcagtggctgctaaatataatatgaggtgtgccattgctgcaataggggattatcccggagaattgtctgcaaacttattattggaccggttgatgggggctgaagtaataataaaaaaagatgatggccgtccatctgcggaacagtataaagaactggtcagggatgcaatcagaaaatatgaggcacagggggaaaccgtttactacataccccttggaggctcagatgatataggcattcttgggtattatgaatgtgcagtggagatcacaaagcaggcggcagacatgggaatcggtgatgcacgggttatttctgcagtaggcagtatgggtacctatatgggactgtattgcgggctcaataatgaagactccggcctgaaattaaccggtgtggcaatttctccgtttgatgatgataaagagaaggccattgtggaactgtttgacagcgtaaaagaaaaatatggaatgaaaataagtgccggacaaaaggattttgatattgaaaaggattatgtccggggcggatataatcttccttcaaaggaggtaagggattccatttgtctgatggcaggaaaagaagccgttttactcgatccgtgctacacaggtaaatgctttgccgcaatcattgatatggttcaggaggggaaaatcagaaaaggtgagaagatcatcatgattcatacaggaggggcgccgggattatatacgaagcatcatagggtggaatttgaaaaggaattaattgatggagttacaattcttggttaaataaagggacgatataagagcaagtcctttaaaaggcggcgttcttgatgggaaaatgagcggagcgatggacagcttcgctcttttcaagattaaataagttgatatggattttgatttgtaatatacttagatggtattatatttgtaatgcaatactataatgtgatataccggatcaattaagaagggaggcggctatgaaacaaaaattaactgttgaacagcgtcagttattgtctcaaaaccagatatcttccctggaattgcttgcattatgcaattacgagctgaaccggtttatggaaaatgaatatatggaaaatccgttgctggaacagactaatactgggaccgaatcttatgatcaagaagaatatcagacctggtatcggtcaaattactgtaagcctttaactaattctgccggattttatgaagaaggtataggaacaaacgaccaggatttggaaatctcaaacactaaaaatattcatagccacgtttatgatcagctggccttggatcgttacccggataaagaattgaaagtcattgattttttaattcatagcctggatagtaatgggtttatagatttagaggttccggagatcgctcaactgacgggtgcaagtgagcgggtgatcgaaaaatgtttaatagatttaaaaaagctggaacccgccggtatttttgcaaagaatctggaagaatgtttattaattcagattggaatactgggattggatgatgaaaacttaaaatatattatttctcatcatttaacagatgtatctcagggaaagctcagttcaattacccgtgcgcttgatatctcttctgcgcaggcgaggagatatgttgctcttatcagcacattaaatccaaggcccctgcaagggttcggagagagccaaaagcaatatattataccggatgttatcgttactatggacacggatgggaaatggaatatagaaatcaatgataattggtgcgggagttatcaattgaatgattattatctccagatgatggctgaagtaaaagagccggagctttttgaatattttaagaaaaaattagagcgggcgagatttctgattcatgcagtggaacagagacgtaagacgattattcaaataacaaatataatactggaagagcaggaagagtttttccggtattcagggaagcttaaaccatgcaccatgacccaaacggcagaaaggatgtcagtcagtacttcaaccataagccgtgctgttaaagataaatatcttcagtttcctgcaggctgcattctgatgaaaaatctgttttcagcgccagttcctggaaatgacggcagcttgattaattcggatggtgttaaacaattcatacgggaactggtggatggagagaataaagaaaagccatatagtgattcaaagctggcagaattactgggtaagaaggggttgacctttcccgcagggttatagccaaatatcgtgaagacataggcattcccggcagctttgatcggaaagtgaaaaatgatatcaataaaagagtcaactaatatagttttggttgactcttttgaattgtacaaagggatcagtcaataacaaagttttcagaactgaaattggcatagtaccggcctgtctgggctgtaaactttaaaacacaataatccggatcagtaacgcctttgggataatacatggtatcaccttcttgccagatcatttccttgctttcttcatcctctaagacttccatggtaccctttaacataacccccggaaaaaacgtttgtcacaaaaataaatacatgcctttggattcctgtgaaattgagcggcccgcatggaagacgtatttgtagtaaaataaaaggttttgatcccatcccgttttcttggcggcagcattgcctttgtattgggaaagccatcctcatccaaggagcttataaaagaaactccctgcttatcgattaaattgccgatggtctgcactgcatctctcatcatcttatatccctcctgaatttatctgtggaaaaactataacacaaaaaaagctgacagtaaattacacacatttttgtgggtatgcctagtctataaaaccgttttcttttaagaagtcagccatgtcattttctttcataatgtcaatgcctatggtttgcatgatcgtaatggcatccaacagctttttgcctcgttcagtcaaatagtattcaacttttaacggatatccctcaaaggaatgcttggctatcattccgtaatccaacagttcttttagctgttcaagaagcattttctgattaatgcccttaatgtctttctcaagctgggacaaagacataacgccttttccaagctgccataaaatgatgggtttccacttcccttttgtaatatcatgggtcaattccaaggggcaagtgtatacatcgcgtattttcatatcgtcacctgcaaacctttcatttatttgtgttttggtgatttcccaatttcctgtgccaggactccccaatagattcgattctgatcaacacatcagccgcggtcaccattacagacatcctaattcctcccattgtttttgtcaacggtgatgtgaatacgaaaagtcttgttattttgcagatttggaatggggtatgataaacattgataaataagttgtttcagcatatagtaatttacaaaaaaataaaattgcgcgtaacattttgtatgccgtaagcgtctttatgtatgtacgtaccatgatccggattacaacagccagtcaagcggaaattcgaaatccgctttgttacttgctcacagcgtccccgatagtgcgggggaggctctgccccgctttaccgggcataaccgaatagcagctatcgctgtttgtcaggtggagcttgccttaactgattcggttaaaatataggatgcatgttgcaacagtatggaggcaggaatgaggaacagacaaaacaacagggaaatgattgaaaaactttgcgcggatacctggcgggagctgtatggcttcatttattataaagtccaaaatcgcgaagaagcggaggatataacacaggaaacctatgtaaaggcgatttcttttttaaacaggaatgatgttaccatccttgaatgcaaaaaatatttaaagatcatagcaatgaatgtcattcgagatcaatggagggcgaaaaaaaggcggaacagcagtgtcaatatagaagatgtgaagccggaagagatcgccctggaggattttgcggattcactgaccgaaaggagccggatagaagaggccatgggctgtctgaccaaggaacagcagacggttattgaattaaggatcatcaaagggtatacggttgctgaaactgcgaagctgatgcagaaaagtgaaggagctgtccgcgttttacagctgcgcgcggtaaagaccctggcgaagatcctggaaacagtataaggtaaggaggaaagatgagaatggatgaaaggaaattatcccaatacattgataatttaaatgccggtaagacgcccagggagcacataaccagattacaggaggaagaaaaagaggatgagattctgtttgaaaccgtaagaaaagtcagaacactccgggaaatcgaatatccggatgattcattccagcagcgtcttgtaaattccgtaacagggagagaaaagtcaaaaagaaacccgttcagaaaatatgcattgctctgtacttccgctgctgcagccatactgctttttgtgacagcctactatttccttcccaacagggacgctggtatcgtatatgcgatggaaaaggcaatgaaggggatccaggcctatcatggaatcatagaagtaagtgagaccaacggattaggggaaaccataacccagtcaaaaagagaggtgtgggcagataagaatgggaattactatattttagaccttgaagggacttccaaaggaaccgtaacagccaacaatgggaaacagaagtggcagcttcggccggaggaaaaggcagcttaccttttacctgcatttcccgatgggttccggtttacctttgagcttggaaatgaaattaacaatgtttcaagggcacagacagttaaaacaattggtccggaggtcatcagtggaagagatgccacaaagcttcaaatcactccggaaggaggggacccatattttctctgggttgatgatgagacagacctgcctctgcaaagagtttcggcaatgcagaatgcagtccagatcaaggcagaatacacctcaatggaattcattgatgaaattccccggaaccttcttgcctatgatacgccggagggttacgaaacggttgatacgaatgaggaacaggaggttgcttctcttgaagaagcagaaaggctggccggctttatgcccgagcttccggatcagacagcagaagggtacacattgaatcggattgccgttgaaaaagagcagggggcaatcaagctgtattactcaaacggagatttagaggacaccattctcctggtccagtcggaagcatcagaagcacttgtgccgtcttctgcggcaattcttggagctgtgaatgaaaataaggctgaaatcataactatagaggagacccaatcaattcgctggcaggagggcggcatggaataccgtatacttggagctgtacccttagataaattggccatttttgcagagggcctgtcccaaggaaaggtagtgataccggaacgtggtgaacataccggagaaccgcagattaaggttgaagtggaccaatcagtggaagagaatgagcagaagagcgttgatgcaggccactctccatggaagctggatccggtttttgtgtcccaggtatttgcaagtctgcttttgtcgccggaaggcattgtgggagattatcccattgcttatgaaaacatcgaaatcatttccaataacgggattgatgcggttgcagaaatcaaggatgacaaatctgttgcaaagtacgtttatttaaaacgtcttatacgcaaggatgataccggtatctggactgtggtcggatatgatcctgctggatcataaactttaataagtgtatggtcttgtaacgtgtaatatcaaaagaggacataagggacatttttgtgaaaacagagaaaaggattgcaaaaattctctgaaattgtataataaaggagtaaagatatagtatataacccatgccgaatgagcatgcaggtgcagacgggcagcagataaaataccatgaaggagtgtccgctccggttacgtattttattatgaggccggggtaaactccaataaggagctgcacgaaacggttcacgtaatttgtggagaaatggagaaccttgctctgctccgcaatgcaaatataaccggaagacaggctgcaacaattttgacgatttctgttacagccttttccagggaagaagtcccgcacagggcaggcagacaagcgtccataatatgaacagggctgcgcatggagcgagctcatgatgaattcctggaagattgctgtttgcggctgcagggaacggatcatttaatgaatctgcagggagggaatatgaaacgatttaaacgtgtttttgtagttgttattgattctttaggaataggcgccatggataatgccgcccagtacgatgatgagggcagtgatacacttgggcatattgatgcttccgtggatcatttaaacctgcctaatatggaaaagtttggtttggggaatttacgtcccttaaatcatgtaaagcctgtggctgagcctatggcgtattatggaaagctgaatgaagccagtgttggaaaagacaccatgacaggtcattgggagatgatgggcctttacattacaaagcctttcaaaacctttacggaaacaggcttcccaaaggaactgttagatgaattggaaaagcgcaccggacataaaattgtgggaaataaatccgccagcggtacggaaatcatggatgaactgggagagcatcagatagccaccggtgacatgatcgtttatacttctgctgattcggttcttcagatctgcgccaatgaggaaacctttggcctgcaggagctttaccgctgctgtgaaattgcaagagaactgaccttaagggacgaatggaaggtgggcagagtgattgcaaggccttatgtaggcatgaaaaagggcgagtttaagaggactgccaaccgtcatgattacgccttaaagccctttggcaccacagccctcaatatattaaaggatgcaggcctggatgtgatcagtgtaggaaagatctatgatattttcgacggcgaagggctcacagaaggcaacaagtcccaaagcagtgttcatggtatggaacagaccatagagctcgcaaaaagagattttaacgggttgtgctttgtgaatctggtggattttgatgctctctggggacaccgccgggatcccttgggatatggtgcggaactggagcggtttgatgaaaagctgggagaacttcttcctctcttaaaggaagacgatttactgctgattacggcagaccatggcaatgatcctacttacaagggaagcgatcatacaaaggaaaaagtgccgttactggcctattcaccgtcctatgatcattgcggggaattaagagaacgggatacctttgcagtgatcggagcgaccgtattggataatttcggtttgcataaagctgagaatatgatcggtgaacccatggaggaattgctttaggaactccagatgtccggaggattcacctgcgtaaacaaaagtaaaaataaaaagacagcacttgattttttctgggatgattttcatgtcattcatcagaaacaaagtcaggtgctttttttgatatttcccatggggagtatgccctcaccatccgttttacacaaagtaatccccgtaattttcctttaaataagcttctatctcaggctcgctttttccgccgatttccgacacaaagctggcggttaagaagcggtgcttccgtgttgaaaagccgtgtgccaaaagggtttccatatcactgctgtccacaaagaaattcatgcggatgacaggaaggtcctggctgttaaggaggttaaaaatacgggatgagaaacaaaagatgtaatcataatccatgcctttcagcttatggatttcgttaatgttcagagtgcccatccattgcagctctacatattcctttgtctgctccagaaaaaagctgacccgttcaaagttgatgctggtcatcaccacgattttcttataatgccgggttatggtccggttgcgcaggatgtgtttttgcaccagcagggtcagggtggaaacgtgttcgtccataaaggaaaaattgtaggaggccttaaagtacacctcatattttctgatggtttcatacagatatgaaaactgttctttcgtattttctacggttttgtccacaaaggtacaatggaagtggttcagggtgatctcccggtagaaatagctgtatagctcattgataaattcttcctggatggtaaagggggtttttaaatgattcaccacctgttccgtaaactgttccgtggtatgccacaatcgtttgtcaaagggaaaatccaggctccgggaaaagttcatcatgctgaaagccacattgtacagcttgttttcccgaaggccgtcaacgaagcggatattaagcggcgccaggggcagccggtagcaaaagtccatggattcatcaacaggccggatttccatgatgcagataaacagcagaagaaactttttggaagggtagttcagggacaagttgtattctgttaaaaaggaattcagctgttccactgcctggcgggacactggctgtaaataggtgcccgccagatcatagctttgtttttccagaggagtgttggcataacgggcctcgatcctgttttctgctgtaaattccagcaaagggtgaaggatgtcgatcacaagaaaccttaactgcagctcatcaccttcaatggtaagtccttttttctttaaggtgagaagggacaggccgtgcctggacaaaaattgacggagatgggcggtatcctgctttttcgtggtcagggaaagcccccaatattcatacagggaagaagcgttgacatagccgttgaaaaaaatggtcacaatcatgacgcggatccgctcgatgtaagaactggtataatcgcccatggtaatctgctggataaaatccacaaattccttgtagcttaaacggcttaggcagaagcctttttgtatttccaccattggctctggagagaaaagattgatccgttcaatagtccgccgtatggatatttcatccttttgaaactgcagggccacctttgataaggaaatgcgctgccttttttgcagaaaacgaagcaggcttaaatcgctgtagcttaatcccatagtgtgttcctcctgtgccgttgtggctgtaatggtttcattataaatttaagggcagctaaacgcaacaataaaatgtaatttttttgccttgaagcaactgatcgaatctgccataatgaacacagtttcaaaggcgccttaaaaaaccacaatgtcataacaaaggaagggaaaaaatatgagcaataaaaagtctagctggaaagacggcatccaaacgtttgggcggtctctccttctgccaatcgcgcttctcgcccctattggtatggttatgggtatttgcagtgcattagggcagtcttacatgatagagaaattcccgtttttgggaagtcaggttttaaagcttatcttatccagtttacagaccattacaagcattgtttttaacaatattccattgctgtttgccatgggcgttgcccagggaatggcaaagaatgaaaaaggaatcgccgttttttcgtcggttgtgggctatttgaccttaaatgtggtcatgagtgtttatctgaagcagacgggaaccctggctgatccggagatcgcggctcaagtggggcaggggaccgttcttggcattcagaccttaaagattgaggcgcttgggggcctgatctcaggtttggtggctgccaaggtagcggaccggttctaccgtctggagcttccccttgcatttgcattctttgggggaaagaaatccattcccatcatcacttttggattaatgattcccatcggtctcatcatccccgtattctggaatctgctgaccaattttctcatcagcatttcctttatttttacaacgccgtacataggaaacgccatttattacgccttaaaccgtgcgttgattccatttggcttacatcatgttctttcctcaatggtacgttttactgaggcaggcggaacctatatgatcaacggaaccgaatatgtgggaatcctcaatgcaaccaatgaagttttgtttaacttagggcccggcagcgaatactggggccagctcatgcccacccttaccagctatttaggaggcgcacagatgctgaccactctgttccgggtgccggctgttggcctggccatgtaccgcacctcctatctgaaaaacagaaagattgcaaagggtgtgatccttacctgctgtttgactgcgtttttagggaatatcacagagccgctggaattttcattcctgtttatttcaccgccgctgttcattctgtactgtgttatgagcggcattggttccattccatatcaaatgcttcatatctccatcggctatatcaggggtacaatttttgattttggaatttttggacttttgtatgaaaatactcattggttcaatctcattcttttgggaatcgggaactttgttgtgttttactttgtattcaaatggtttattgaaaaatataatctggaaacaccgggacgggaaggatttgaaattgaagaatccgcaagtgttctgctgaaggaaaagaactggccggcgatcgctgaaatcgtcatcaaaggcctgggcggcaaggacaatattctgagtgtggaaaactgcatttcccgcctgcgggttgacttaaaggatccttccaaggtagatcagatcaaaatcaaggattccggctgtgcgggcatcttcttcccgtcaacggatcacattcacgttgtttttgggcctcatgtggaatttgtccgtcatgcggtagacgatgctatgaaaaaataaggggtgtacgatgagagctttctatgattctaagagtaaactggatgacagaggaattaaaaaactgttaggcgaaacagtcaaatacgagacgtggctgaaggtggaggcagctctggcactttcccaggcagaggagggctttattcccatggaggctgccagggacattggggcggtccggcttgaggatctggacttaaatgaaatggagcagatcaaagccagggtgggccatgggtttgttccctttgtaaaagtgctggtaaaagcgtgcaggggagaagggggaaatatgtccattacggagtcaccactcagaatatccagcagacctcccagctttatattgcaaagcaggtaaattctgttttcaaaagctttcttgcagatatcctggaaagcttaggcaggcaggcccgtgaccatagggatacagttatggctgggagaactcatggcaggcatgccatacccatcacctatgggtataaggtttctgtctggatcagcgagcttctcacctccttagagcgattggaggaaagcgagaagcgggtattcgtgaccatgatgggaggggctgcgggaggctttcatgcccctggccttgcaggtcccaggattcaggaacgggttgccaggaaactgggaatgggttccatggaggtgcccagccggaatatgagccagatgaagctggaatatttaatgaatctggcgctcttatgcaatacctttcacaaaatggcagaagaggtttattatactggaatcgaagagttttcagaagtcagcgaatcctttacacctggaaccatcggcagctccactatgcctcagaagatcaatcccaagctttccaaggggatcatcgccaattcccagaagctttactcccttcccgctgtgggattatactctgctgtgcggatgtttgagggagacagcagctcctatatgctgtttgacggcattatggaggaaggacttcagctgactgccgaggtactgatccgggccgaggagctgagccggaccctgcagatcaacaaagagcagatgcttaaaaatgtgaatttaaatcagggacttgataacagcgaatttgtaatgatgaatgtggctgaaaaaatcggcaaggacagggcccatgagctcatgtacgagaaagccatggaaacggagctggaagggaaggattattatcatgtactgacagaggatgtaacactggcttccatgtttacggcagatgagctgaaatccatgatcgatcctgcaaattatacagggctttgcagcgtacttgcagaagagatggggcagaaggcgctaaaaagggctgagaaattaaagagaacactggagccgaaagagaatggcggtgacagggaggctgcggctgaccaataaaggggcagtatttattcaaataaggggatgtggcagtattttgcggcattccctttcatcattaagaatacaaggagagtaacatgagaaaacaacatgtgattacgatttccggagcaggaagtgcccgggtgcctgcacttgtggggacactggtcaattataaggaacgttttcctctttcaaaaatcatcttctatgatatcgataaggagcgcatgggattgatggaggattatgaccgtttggtgttaaagtgctattatcctgaatgccaggcagtgtttaccacggatgaggatgaagcatacagggaaaccgattttgttttctgccagatgcgggtgggaaagactaagatgcgttccctggatgaaaagatccctttgcgctacgggctggttggacaggaaacctgcggccccggcggatttgcctatgggatgcgttccctgggagccatgaagcaaatggtggaaaaggtccgttcctattccagggatacctggatcttaaactataccaatcctgccgccattgtggccttagggcttgacaggctgtttcctgatgataagcgcattttaaacctctgcgaccagccctattccctgatgaagagctattccaagattcttggtgtgccccaggaaagacttcgggcgcgttattttggattgaaccatttcggatggtttacggagcttaaggatgcggaggaaaatgattactttgatgccttacgttcctatttaaaggatcatgattttaagccctttaatgcggaacagcgttccaagtcatggctggatacttatgtaagggtgaacaaatacatgaagctgatggatgaatacattcctaccacctatttgcagtattacatgtttccggatgagatcgtggctgaaagcgatccggattacacccgtgccgatgaatccagggattccagggaaaaggaagttttcgaactgtgtgcacgggctgtgggaaaggaccggatggatggactggaaatgcttaccaacagcgtgtttgggaacctgatggtggaggtggcggaatccattgcgtatgacttaaacaatgaatttattgtgatggtgaaaaaccaggggatcattgataactttgaaccggaagcaatagtagaggtagcgggaaccattggaaaggagggggcaaagggatatccttttgggtcaataaagctttattacaaagggttaatggaaggacaatatgcctatgagctgttgacagtggaagcatttatggaaaaagattatacaaaagcgctgatggccctgaccttaaaccgcactgtggtggacccttctaaggcaaaagcggtgcttgatgacctgatggctgcaaacaaagattattggacattaaggtaggtggatcatggtactttattcaaaacatatcattcttgaacatgaggaatttgacggatttttagaaatagaacatggaaagatcaaagcattgcataaggagtttacaggggcatatgaggatttttccgattacatcatcctgcccggatttattgatatccatattcacggctgggccacaggttctttttggtttgaaaaaagttccggagcattaagggagatgtgccgtacccttccttatgccggggtcacttcttatctggcaacttcaggagcagataccatatcagaaatcaagcgctgtatcaaagctgcagacgatgcctttgaagcaggttttccaggcgctgaaatgctgggagtccatttagaaggaccctttatcaatccccaataccgggggatgcagcgtgaggaatgctgtattttgccaaggcttgaagtgatgaaggaaatttacaacagctttcggaacaaggaactttgccgctatatgaccattgccgtggaacaggagggggcaagagaggtgctggaattctgcaaaagccatgggatacagacttccattggccacagcggagccaccttctcccagattaaggagataaaggatgccggtgtgggtggagttacccatatgttcagcggaatgcgcggattccatcaccgggaaccgggagtggcgggtgcggctctgtattttgatgatatgatgtgcgaatttgccaagcagacaggtatgaccgtgtctcatgaagcatttgatatcgctttccggatcaagggcagtgagcggatcatcatgaccaccgactgcagcggccttgcccagacccagacggaatttgaccattatgtccggaaaatgaagttcataaaggctggagaccaggtgaggatcgagcactatgacggcagagtggagtggctggatccaaaggattatcaggcagtcagggagatagaactgagttacattggttctgttcagaatatggcaaaacatacccgtgtggactggtttgatatcatgcggatgaccagcttaaatcctgcccggtatattcatgtggatgacaggaaaggcagcatagcacccggcaaagacggggatcttacagttgtggattctgatttaaacctggtcagcgtattctgccggggaaaggagatgcgggatggggatgaaatgtgctgtaagtgactttgacaggaccttgtatatagacggctgtatcagccctgaaaacttagaggcaattagggagtggcaggaggcagggaacctgtttatcattgcgactggacgaaatgagacctctatccgtggttttttggagaaatactctttaaaacccgatgctctcatactcaacaacggcgctttgattttagacggaacaggggaagaactgttttgcagaaccatagacgatgctgcggctaaggaggtgcttcggttcctccatggccttggggaggaagggagcggcgtgtccatgcgaagggccaaggttaatgtcctctcaggctccggcatcaccacccagaagccctgcaaggagcaggtttccatagaccagatcgatggtcttaaggagatccttcaaattcacagacgcaggcaggataaggtgtggatcagagaattgtgtgcccggttaaacgccaggttcccattgatttccgcttacgcaaacgtgtggaatggagatattgtggcgaaaggcgtaaataagtcggctgcagtggatttggtttcaaggcattggggcggatttgatgaaataagggtcattggtgacagcgccaatgacatacaaatgataagggactacggaggcgccgcattacgccgggcggatccggaggttcgggctgctgccgcaatgattgtggaggatgtggcggaatatttatcaatgccttaagagatttttgataatctttaaaggtcggtctccatattttttcggaaacttcctattataatgcataatggcaaaggggaaatgacacccagccagccagaacagcttttgctggatcgcggctggctgggtgtcatttctcctttttgcccctcggtcattgggaatatccgcttgactgcaagaacaaggctatggaagaatggggagtgcccaaacaactaatacatcaatttgaacacaagtaaaacaatgataaatttgattgcaaatattgtttattgatttaatactgttttatctggaagaagatggatgaatatatataatattgaaaatcaaatattgaataggacacaaaacaacaaaaatcacaaatgaatacaatataaaacaaaataaataaataaaatcaaataaaaatattgcaaaaccggatacaatatgctacaatttctacaggaaggacaggttggtgtgtccggaatagaaaactatataatatatttttaaaggaggtttactttatgaaaaagaagttagcaatggtgcttgcggcagcaatggtactgtcaatcactgcatgcggcagcagcggcacatccgcaacaacagctgctccggcaaccacggaagcaaagacggaagctgctaagaccgatcagacgactgcggcggagaaggtagaaaatgcccagtccacaggctctctggcaggaaagaaaattgccgttgtgcggaaccttgcagcaggagaccatacccagcagttcttagacggctgtgtatcggaaggcaagaaatttggctggaccgtagacacctttgtaacggatggcgatgatgcaaaggctcaggagactgtagctcaggtcattgcaaaggattatcagggaattatcgtatctcacggacagctgtcctattcctacgacatgttaaagcctgccagagacaagggaatggaagtagtaacctttgataccatgccatttaagggcggcgatgcaagcggtgagcttctttccggagtaacctctacggctcagaacgatcaggcgctggccgagctttctcttggttacatgatgaaggaatttgaagcaaaaggcggaaaatacccgatgaaagttttaaagacctttatgggccctggaatcccgcctcttgacagacgtaacgaaatctataccaagctggaagcagaaggcaagatccagactctggaagtgattgcaccgtctgattcagctaatgcccgcggcgatatgaccaacaagacagccgctattcttccaaagtatccggaaggttccgtagatgccatctggggctgctatgatgagctggcaaagggtgttttacaggcattaaacgatgccggacgtacggatattcctatgtacaccatcgatgtatccaacgacgacattcagttaatggttaagaatcctgacgtatggaaatctactgcagctgttgatccgaagctgatcggcattgtagatgcccgccttctggctctgaaatttatgggcgaagagactcctgattactttaacttaaatgcatgcaacattgaaacaactcagcttactgctcagaccaccatgagtgatttgggaagtatcattgatggttggggcgatgccgaagatccaaagggcgctttatataccgatgcgatcaagaacaactatgtaaattaaaaaatgctctgtattcaatacataattaaggaagagatgccatgaccaaagtaaatcttgaaatgaaagatatatccatcgaatttcctggagttaaggctttggatggagttgattttagtctggaaagtggtacgattcatgcgctcgtgggtgcaaatggcgcaggtaagtccaccttgatgaaagtgcttgccggtgtcaatacgcattatacaggacaaatttacgttggaggggaaccggtggaaatccggtgccccaaagacgcaaaaaatcttggaatagaaatcgtgtttcaggaggtcgacaccgcactgattccctatctgtctgtggctgagaatgtcatgttcaacaccctggtcaacaaaatggggcacaaacagatcgtacactggaaagaaatcaggcaggcagcagaaacggtattaaaaaaactaaatgtagatgtagatattaataaacaggtatcaggacttactttggcacaaaagcaaatggttctcattgccagatgcgtggcggaaaagtgcaggttcctgattttagatgagccgacagcccctctttccaattccgagactctggaattgttccgggtggtgcgggaactggcaaaagagaatgtgggagtggtgtttatttcccaccgcttaagtgagctttacgaaatctgtgaaagtattaccataatgagagacggcaaactggtgaccaatctgccgctttctaaggaactggaagtgaacactcttgtggaatatatgttaggccgcagctatgaggataattacatcaagaaaaagtgcgagatcggcgggccgttgcttgagatagaaagccttatggaaaaagaaggaaaagtaaagaatatcaacatgaccgtctgcaaaggagaaattgtgggagtggcaggtctggtgggtgcaggaaagacagagctttgcaagactttgttttctgcttaccagcaggcaggcggcaccatgaagcttaacggaaaagtgatcaaggcaaaagggccgactcaggctgtgaagcatgggctggcactggtgccggaggagaggagaaaagaaggcgtcctgatcacggatccggttgtatccaatatctccgtagctgccatggaaaaatatacgggctggctctctgtggtgaataaaaagaaagaaaaggacgatgccagaaatatgatacggggccttgggatcaagacgccatcggaaaatcagatcgttgcgctgctgtccggcggaaaccagcagaaggtggtcgtgggaaaatggcttaacaaggattcagaggtctatattttcgatgagcctaccaagggaatcgatgtgggtgccaagcaggacatgtacgagctgattgaaggcctggcagctaagggaaaaggtgttatatatgccacctgcgaattccaggaaatattaagtatctgcgaccgcatctatgtgatgtatgacggagaaatcatcaaagaattaaactcagcggatacaaacgaaaaagaactgctttattattcgacaggaggtaaatgatatgtctggggcagagaaggtaaaaaagaaaaggaacgtcggggattttgtgacaaaatggggtaccatcgcaacgatgctcatcatgttcatcctgttcacattcggaaactggagtaaggatacgggagcgagcatgtttctgacccagtctaatatgatcaccatccttcgtgcggtatccattaccaccatcattgcaatcgggcttacgtttgccctggcggtaaacggcatggatctttccattggagctacggcccagtttgccaacgtttttgttatgacatgctttgtatggcacaatattaatatcggtgtttccatcatccttacggtgctcatttgcttaagcgttgcagtcatcaacagcattttgatcgttaaattcaagataccggatatggttgcggcactttccgtaatgtttatgtatcagggagtttccatgacctattccaagggcggtgcaatcaccgaacgcatgacccgtgccgatgggacccaggctcccggtcttgttcctgaagccttccgggcattgggaaaggaaccgtggctgatcatcatcatgatctgtgtggttctgtttgcatactttttcttgaattatacaaaacacggcagatacatgtatgcggtaggaggaaatcctgaggctgcccagctttccggaattccggtagcaaggtataagatactggcatactttttgtcagccatctttgcatccatcggcggaatctgtcttgcggcccgtgtgggaacggcccagatttcagcaggtgacgcatacttaatgccttccgtatgtgcggcttatatcgggttttctgtattgggcgcaggaaaagccaatgcattcggcacctttgcgggagcggtgcttgtgggtatgctggaaaacggtcttatcatgatgtccgtgccgtattatgccatgaacatcattaagggagctgttcttgccattgcccttgccatgacctatgcaagcggcaagacaaaaaatgtaaactaataacagaagcattaaaatgatcaggggaaggtgacaggaatgtctaaatacgacagttattttttgatgaaagcggaagaagtaccgggttatgttcaggagaagctcacctattttgatgaggatgccaggctggaatgcaaagagatcggagacggaaacttaaattacgtgttccgtgtgaaggatccggcaagcggtaaatccatcatcgtcaagcaggcaggagaggcgcttcgtatttcagcagaaatgcatgtttccacagacagaggaagaatcgaagcaaagatcctggggatccaggattcctatgcgccggggcttgttccaaaggtttatttatatgacggaaccatgtgtgccatggtcatggaagatatgactggtcataccatgatgcgtaccggcctgttaaaacatgagatctatccaaagttcgcagaccatgtgacaacgttcatggtaaattcccttctgcgcacaacggatgttgttatggggcacaaggagaaaaaggagctggtcaaaagctttattaatccggacctttgtgagatttcggaggaccttgtatacagtgagccatttatcgattacaaccacaggaacaatgtatttcctcctaacgcagattttgtaaaaaaggaattatacgaggatcaggccctgcatctggaggctgccaagctgaaattcgaattcatgaacaatgcccagtccttgattcatggagatttacataccggatccgtatttatcaataaagagcatacttatatctttgacccggaattcgccttcttcggccccatgggctatgacatcggcaatgtcattgcaaatatgttttttgcatggtgcaacggcgatgccaccatagaggatgaaaaagaaaaagaagagttctgcggctggtgcttacgcaccatctccgacatcgtggacttattcattgaaaaatacaaccaggtgtttgatgaacatgtaacagaaaccatggcaaaggtccctggatttaaggagtggtatctggaaggaattctctccgacaccgccggtgtggcagggcttgaatccatccgccggaccgtgggaatggccaatgtaattgatattaccacaatttctgatgaggaaaaacgggcaagagccgaaaaaatcatcatcactctggcaaagaattatataatgaaccgccgcagcttccgttgcggagcagattacttaaatgcaataaaagaagcaacaggcaagttttaaggccggcaatgaggatcgtgagccggaaagataagaaggggataaggttgaaagagaaaacacccttcaaccttgaattagcgagtcaactggatatgcaggtacatccgcttgattcatcaggaggcagaaatgagcgaagaaacaaaaaaatccatcatggactatgacactgtggctcttgacgaagaaaagaacgccctggtgatcattgaccagacacagcttccgtatcatacggaaatcctttccctgacaaaacaggaggatatttggaatgcaatctatttattacaggtaagaggagctcctgccatcggtgtggcagcggctatcggcatttatctggcagcaagagagatcaaggcggatggctttgatgagttttatgcagaatttcaaaaggcaaaggactatcttgactccgcacgtcccactgctgtcaacttgtcgtgggcgcttaaacggatggaacaggtagttttaaaaaacaaagaaaaaacaatccctgaaatcgtagagcttctccataaagaggctgtggagatacgggaagaggatatctgggtctgcaggatgatcggggaatacggcttatctctcgtaaagccgggggacggccttctgacccactgcaatgccggacagctggcaacggtaaagtacggaacagcgacggctcccatgtatttaggacaggaaaaagggtatggcttccgcatcttttccgatgagaccagacctcttcttcagggcgcaaggctgacctcttttgaattaaaggaatcaggccttgatgtcaccgtgatctgtgacaatatgtctgccacggtaatgagaaacggctgggttgatgctgtttttgtaggctgtgaccgggtggcagcaaatggggatacggcgaacaagatcggaacctccatggtggccctggccgccaaacggtacggtgtgcccatgtatatttgcgcccctacttctaccattgatttaaacactcctacgggcaaggagatccacattgaagagcgtccggcagaggaagtggtggaaatgtggtataaaaaaaggatggccccggaaggtgtaaaggtatttaatcctgcatttgatgtgacagacaatgatctgatcgcagggatcgtaacagagtacgggatcgccagagcaccttatacagaatcattaaaggaaatattcaggaaaaaggaagaggccctgaaagcaaagaaagtgtgagcttcagtatatccgccggattgtgaaggaaaaagctgagcttggcatatgaaaagaggatgtctcaaagaaactgagacatcctcttgccaaaatcagactatatttccgctgcttcgtaaagctccacattattttttgaaagatattctctccactggtcgtccatccgtttgtcagtaaccagccctgtgatggtctcaaagccggatatccggataaatgaggtcttatcaaatttggagtggtctgcaatgagatagacgtgattgctcctggtcatcagcatctggcgtatggcggcaatggcttcattggaatcggtgataccgtgttccttggaaacgctccggcaggacataaaggtcttgtccagataaaaagattccagatttttaagggcggtatttcccacaaaagctttgtcccggggtgtataggagcctccgatggaaatgaggcggatgtcctctttgtcatacagctcattgatgatcagcagggagtttgttactacggtaaggcgcattccctgtaaggcctttgccagctgaagggccgtggtagaagcatccaggaaaatggagtctccgttatggatgattgacaggcattttttcgcaatggactgcttactctccatatatgcggtttcccggatcgttaaatctacgttattctcaaccccgtcttgtataaatgcaccgccgtatgttctggtcaggaacccgtcatcctctaattgctttaaatcccgccggatggtttcctcggttacggagaaaattttggaaagttcggttaccgtaacacttttcttttctaaaataatatctttgattctggctttccttgttactgctaacataggcatattcctttctttatggcaataaatgttaatttaaccgaatcaagtgaacaggcagcaaaggctgccattcggttatgcccggtgaagcggggcgcgctgtgaggaagtgtggaagcggaggatctgcctcttggtcattgttaaatccgcttgacaaataaaatacaatataaaaccatagaaatcaggtggtatataagtatattgtataattattttaaataaatgtaaagaagaaaaggatgaaataaagataaaacagtaaaatcaaaaataaaacaacatgaaatattgacaaacagacataaaaatggtacaaatacagtataaaagaggaaggttcggacagaaagaacatgtagttgtttggactttggaggtaaagatatgatgacagttcaaggcgtaaagtacatgtctgattttgaggccaaaaaggcaattttggacatcggcagacgtatgtacgacaaaggctttgtagcctcaaatgatggaaacatcagctgtaaggtagggccgaacaccatctggacgacgcccaccggggtatcaaaggatttatgacccaggatatgctggtgaaaatggatttaaacggaaaagtgctgatgggaagatggaaaccctcctcagaagtaaaaatgcatttgcgggtttataaggaaaacccggatgtgcaggcagtcacccacgcccaccccttagttgccaccagcttcgccattgcagggatcagcctggatgccgcggtccttacggaagcggtgctggggcttggatccataccggttgcaaaatacgcgacgcctggcacggatgaagttccggattccattgccccctttgtgaacacccacaatggcgtgcttcttgcaaaccatggagcactgacctgggggaaagatatttaccaggcattttacaggttggaatccattgaatattatgcgactatattgatgtatacgggcaacatcatcgggcgccagaatcttctttcctgtgaccaggtaaataagcttttggatatccggcataagcttggcatcacagcaggcggaattcctccctgcagcctggaggaaaccaatatgcaggatgtggtttcagctgcaaatgtccgtcaggcagagcggacagggactgagcctgtattaaaaggggtgacttccattgtaaggccgggagagaatctggctccatcaggctgcggctgtaccggtgtgacacggcagattatggcctcagaggaacaaaagcctgtggaggcggagatcttaggcaaggcaaaggaggaaatcatagccgaagtggtgagaagagtgatagagcagctaaactaggaggcagatcatggaaattggggcaaaagagatagaactgattgtaagggaagtgcttgcaggaatagaaagcaggggcataaagccttcttataccccctcccggagtgaagacggggtatttgaacgggtggaggatgccattgaagcggcatacgcagcccaacgggagtgggtagagcattaccgggtagaagacagacgcaggatcattgaggccatccgggtgacggcaaaaagccatgcagaatccctggctaagatggtttgggaagaaaccggcatggggcggtttgaagacaagatccagaagcatatggctgttattgaaaagactcctggcgtggagtgcctgactacggaggccatttccggtgacggagggctgatgatcgaggaatatgctccttttggggtaatcggagccatcacgccctccaccaatcctacggagaccatcatcaataacaccatcagcatgatagcaggagggaattctgttgtatttaatgtccatccgggtgcgaaaaggtgctgcgcccattgcttaaagattcttcatcaggccattgtggaaaacggaggcccggcaagcctcatcaccatgcagaaagagcctgacatggaagcggtaagcaaattgacgtctgatcccaggatccggctcatggtgggtacaggaggaatgcccatggtaaatgccctgctgcgttccggaaagaagaccattggagcgggtgcgggaaacccgccggtcattgtggacgatacggcagatgtcagcctggcggcaagagagatttaccggggagcttcctttgacaacaatatcctgtgcctggcggagaaggaagtctttgtcatggaacgggctgctgatgagctggtgaacaagcttataaaggaaggcgcgtacttgcttagttccctggaattaagcgagatccttaagtttgccatggttgaaaaaaacggcagctatgaagtgaataaaaaatgggtgggaaaggatgcgggccagtttttggaggcaataggggtttccggccataaggatgtccgccttctgatctgtgagacagacaggagccatccatttgtcatggtagagcagttaatgcccatccttcccattgtgcgtttaaggacctttgaggaatgtgtggagagtgcgttagcagcggagtcaggaaaccgccatactgcttccatgttttccaggaatgttgagaacatgacgaaattcggaaaaataatcgagaccaccatttttacgaagaatggttcgaccttaaaaggagtggggatcggcggagagggtcatacgaccatgaccattgcaggtcctaccggagaagggcttacctgtgcaagaagctttacaagaagacgcagatgcatgctggcagagggtggcttgcggatcatctagagaggggaaggtacatatggccatcggctttttggaatgtgcaggatatggggctgttctctatgccatggataaggcatgtaaggcggcgaatgtgaggatcatcggtattgataccattaatcccaaggatgcaactgcattcattccccttacggcccaggtgaagtttgaaggcgggattgacgatgtaaaagaagcctgcgaagtggcaaaaagggcggctcttaagatcaacaggccggaagaggtcctggtagagatgatcgaaaaaccatatgaaggaacaagggcattgtctcatatcacaaaggtagatcttgtggaagaaaatattgaaaatttcaggaggtagcaaaaatggcatctacatcaattggattaattgaaacaagggggttgaccgcatccatcgaagcggcagatgcaatgttaaaggcagcggacgttgagcttgtggggaccgagaagatcggctccggccttgtaaccgttattgtaaccggagaggtaggcgcggtgaaagcggccaccgaggcaggcagtgaggcggcttccagagtgggtgagctggtggcagtccatgtgatcccaaggccccaccaggacattgccaagattttgccgaaagtcaaagggtaaagggaagcagctttctaataacaggcatcagcaaaggtgggcgtcatgaaaacgaaccgaaacgccataggggttttagaagttaattattatgcaaataccgttgtggtggtggaccaggctttaaaggcggctgaagtggagatcgtaagctgccacaagaagctgggaggcaggatgtgccacacggtattggcgggtgagacctccgcggtccgtgccgccgtggaagcggccagagaggccgggaggatggtgggagacgagaatgtgaaggtgtccgtttccatcgaaaaccctcatccggaagtgttgaaacttttaaatatgatagacaggcatgagagcgaaaaggattctgcagaagcagaggaagaacaacgcaggaataaggaggaaaattaaatggcagaggcggcagtaaaaaagggaatgttagcattgggaatgatcgagacaaggggacttacggcctccatcgaggcggcagacgccatgttgaaggcagcggatgttgaaatggtagggaccgagaagataggctcaggactggtatccgtcatggtccagggagatgtgggagccgtcaaggcggcagtggaagcaggagaggaagcagcctccagagtgggagaggtagtagcggttcatgtgattccaagaccccataattccataggcggaatccttccgtttcttaaataggaagaacaggaaattgactgagggcggaggcttacaatggaaaacagggaagaactgattcaaaaggtaacctcactggtcctggaaaactggaagagactgagtacacggccctttcaggttcctgtaggaatctcggcaaggcatgtgcatttgtccagagaacatgtggaaatgctttttggaaccggttaccggctgactcccagtaaggctttaagccagccgggccagttcgcctgtgaagaacaggtggctgtctgcggcccggcgggaacccttcctaaggtgaggattcttgggccggagagaaagcagagccaggtggaagtggcttccagtgactgcagagttctgggaatacagccagccgtaagatcgtcaggagacttaaagggaactcccggaatactgttaaaagggccaaaaggagaggtgcttctgacagagggagtcatcattgcggaccgccatatccacatgacgccggaagatgcccggtggttcggggtattggatcaggatcgggtaagcgttgtggtcaatggaccaaaaggcggtgaactgggtcaggtgctgatccgtgtcacccgtgacagtaagctggatttccatgtggatacagatgacgccaatgcattccagctgaaacagggacagtgggtgaccattagaaaggaagaggctaggtgatattaggaacaataatgggaacagtggtttccacgagaaaatgcaaaagcctggttgggttcaagcttcttttggtagagccttactatggagataagaaggatatttttgtggctgccgataccataggtgcaggaattggggaactggtactggtaaccaccgatgataccacccaatatgcgctggaccgttcggcgccggtagatgcctacattgtgggcatcgtggatgcgccgcctcagccggggaagtgagaaggagagggaacgcttatggaacaggaaacgcttaaggttttggcagtggcagatccggcagtagaaggctatctggatgaagaactgggaatattaaaggggtatggaggaagagtagatttccatatcgttccctgggcggattactatcccatgatgatgaaggcatttgcaggggaagcagattatgacattgtcatggttgcgggccatttatggcttcgcgattttgtagaaaagggatatctttctgagcttgattttgaggaggaagacatacttcctgtcattgcagaggaaatgaggtacaagggaaaggcatacttgtctccctccttttgtgacggccatatgattctttaccgcaagagcttgcttcaccaggtcttgggaaaggaacttgaaaatgtcataacaccccaggaatacatagagacggcaaaggcttacaaggaggcctgcgggaagcaggcagtggcaatgaaagctgatcagtctgaaatctttaccgatgcacttccctttctccgcatgtatggaggagatgcttatgatcttcatggaacagcggcctgcgggaaggaagaaacggtaaaagggcttcagtcttatgtggaattgaaaacttgtgcagttgacggcacggaagccttcggaaacggggaaattgcgttggctatccgggagaaaagagcggcaatggctgtcacctggagcggtcagatgggggaagtttttaagaaaggctgtctggaaccgtgggatctgggattttgtaccttttctacggcctggaacgtgacctggtcttttgggatctgcttaagctcagggaaaaagaaagctgcagaggaatttcttaagtacctccggtccccagaagtggatggaaaggtgggaaaaaagagcggagctcccgtaagaagggggagttatctggaaggagccggggagtgcccctggtttccggtgcagcaaaagatgatggagcttgcaaagcctctccccgtttatcaaaggcaggggagaaaaacggtgttttttatgaaaaaatctttgaggcatttaccggaaaaaagacggcacaagaagctatgagagaggccggtcaggcaattgactctatgatatgatcagggagaaaacatgaagattattataattggaggagttgcggcgggcatgagcgctgcttccaaaatccgcagggtggacccgggtactaaagtaacggtctatgaaaaaggcggttttctttcttatggagcgtgcggacttccttattacgtgggaggatttaacgatgactaccgcaaaatgatcgcccgcacccgggagacctttaccaaaatgggaataaatacctttctccgccatcaggtattgtctgttgatgcagaaagaaaagaggttcttgtaaaaaatcttgaaaatggtcaggaatttaaggatacatacgacaaactgatgatcgctacaggggcatcgtccgtggttcccccttttcccggcaaggagcttatgggggtccatgtgctgaaatccatggaagacgggatctttttaaaggaatacgccaaattgcctgaaatccggaacgtggtcatcgttggaggcggatatattggagtggaatgtgcggaagcgtttttaaaccttggaaaaaaagtccgcatcctggaagcggcaaccagaattctggcgccttttgatgaggagatggccgccttggctcaggaagagctggtaaggtccggagtggagcttaataccggagaaaaggtagaagagtttttcggagacggtctttatgtgaaacaggtaaaaacagacagaggaatttatgaggcggatttagtgatcgttgcggcaggcgtccgaccctgtacggaatttttaaaagatacgggaatctccatgggaaaaaacggtgcattgatcgtggacagggagatgagaacctctttgcctgatgtgtatgcggcaggagactgtatccttgtctataacgaagtcttagaggaagacagctttttggcccttggtacggtggcaaacaaatgcggaaggatcgcaggcgctaatctggcaggcggtcacgagcagttcctgggcgccctgggatcggctgcgatcaaggtgtgcgggctggagcttgggcgcacaggcatgggagaagcagatgccaaacgccttggaagggattacaagacccttgtcattgaggccaatgaccatccggcttattatccaaatcccacacccatcaccataaagctgatttatgaaaaggggacaaaaaggctgctgggtgcacagacttgcgggcaaaaaggagctgttttgcgggcggatgtgtttgcggtggcaatccatagcagaatgaccacggcagaactgggaatgacggatcttatttatgcgcctcctttttccggcgtgtgggatgccatccagattgcctgcaatgcggcaaagtaatggagtgaaggatagaaagtgaggtcagaccatgaacaaagtcatgtctttgcaggaggcggcagcccggatccatgacggggatatccttggtcttggaggcaatgtgctccaccgggcgcccatggcaatggtgcgggagctggtccggcagaataaaagggatttaaagctggtaaagaccgctggggcaatggatgtggacattctctgtttcggaggctgtgtttccagcgttgatgccggctttatcagctatgagagcgaatattccctggcaggccattaccgcagggcggttgagagcggagctgtaaaaggaaatgaacatgcctgctatacggtgatctctgccctgcgggctgccagctatggggtgggctttatgccggtaaagggacttgtgatcagcgatctgatcgatgcaaatgattattttgtgcgggtcgaggatccatttacaagggagccggttaccgtggtacgggccataaagccggatgttgcggtgattcacgttcaggaggcggataaagaaggaaacgccaggatcacaggaccgttgtttgaggatgttttattttcaagggcagcaaaaaaggtcatcctgacaacagaaaatattgtccacggatcttcctttacaggaagcttaaaaaagtcggatatcccccattttctggtggaagcggtggtcagggtgcctaagggagcttcgccctgttcctgcccgggagtctacgatattgacggaaagaacttaagggaatttaaagaactgaaggatttggacggccttaaggcttatttaaaggcatttgaaacgtctgactataaaggataagggggcgtggcctgatggaagaaaaatacagaatctgtgatattatggtctgcgccatggcccgcctcatacccaacggcggcaaggtctttcacggggtatcctcccatatgcccatgaccgcgctgctgctggcaaaggcgcttcatgcgcctgaggcagtgcacttgaatattccgggaggagtggacccggatccaatgaggcttaaaaaatataccagtgcaggtccggagcttttggagcgttctacaggatattttcctttaatggaagtatttgacctggccatgagaggggagctggatatggcattcttaagcgggatccagtttgattttcacggcaatgtcaatgcgtcggtcattggagattataagaaaccaaaggtaaggatgccgggaggagcgggcagtgccgttctcattccaacggcaaagagggcgattctctggagaacaaagcacgataaacgtacctttgtaaaacaggtggattttgtgactaccaggggaaacgtggaccggatcgtcactcctttatgcatctttaaaatggaaaacggggaaatggtcctggaaaccattcatccaacttccagcctggaagaggtaagggataataccggattccccataaaatactcccatatcgactatacgccccttcccacaagggaagaactgaacgcgctgaaacggatcgatccgggagatttcagaaatatagaattctaaggaggccctttatggcgcttgaaaggatcaatgcagtaggaaccagcttttttggccgcggctccattggactgctgccggctgagcttaagaaacggggatttaaacgggggcttatcgttacggacccgttcctgtataaaaatggtaccggagataaggtgggagcctgccttttaaaggccggagcggaatatgccatttactatctggtggaacccaatccttccacaaacgtcgtaaatgaatgcctggaggcggcaaacgctttggaggtggatcttttagtggcggtaggaggaggttctgccattgacacggcaaaggcggtcagcattgtcatggcaaacggcggcagggtggaggatttcgagggcgtggaccgttcccggaaaccggggattcccattgtcgcggtaaataccactgcaggcaccggttccgaagtgacctccttttatatcgtgaccgacccggcaaggcattccaagatgtgcatggtggaccccaattccatggtcaccattgcagtcaatgatgtggagctgatgatgaccatgccaaagggtcttacggcttccacaggaatggatgccatgacccatgccattgaggcggccgtggcaaagagagccaccccttttaccgataaagacgccctttgggcaatgggcgtgatcagagaataccttccggaagcggtgtctgacggaagcaatgagaaagccagagagatgatggcttatggagaatacagcgcaggaatggccttttccaatgcaggtcttggcatggtccatgccatggcccattccctgggagggcttaagaatctgccgcacggcatctgcaacgcggttttgctgccctttgttatggaatttaacggaagcaggccggaggccgccaaacggtataagaaggtggcagaggggcttaagcttcccggggcagctgcaatgacgggggaagaggctgtaaaggaatcggtgtcctgcatcagacggctgtcaaaggaagttgggattacgcagaacttacgggaacttaaggtagatcctgaagattttaaggatctggctcaagtggcgatgcgggattcctgcatggaggacaatcccttcaaaccgacggtccgggaagttatagaagtatatgggaaagcgtatggcctttaaatgatgggaaggagagggaaataaatgaaaaaactgattaatgtgccggaaaactatgtaaatgaaatgctggaggggatttatcttgcccatcccggctatgtcacttatacagcaggcgaccttcgctgcctggtcacctccaataaggtggagggaaaggtgggaatcgcgaccggaggaggttcggggcatcttcccctgtttctgggatatgtgggaaaggggatgttagatggctgctctgtgggagatgtcttccagtcccccagtgcggagcagatgcttcaggttacaaaaagcattgattccggagcaggcgttctttatatttacggcaattataacggggatatctttaatttcgacatggctgcagagatggcggatatggaagaggatatttgtgtggaaagtgtggttgcaggggaagatgtggcatctcccaaggcagcccccggagagaagaacaccagaagaggggtagccggtatcttctttgtatttaagtgtgccggagcggcagctgcagcaggaaaggatttgcaggaggtaaagcggatcgccaaaaaggcggctgccaatgtaaggaccatgggagtggccctgaccccctgtacggtgccgagagtaggccatccgggatttgagatcggagaagatgagatggagatcggcatggggatccatggagagtctggaatccgccggggcaagctggagagcgcagatgagatcacggcggagatgatggaacggattctggcagatattccttacaatgccggtgatgaggtggcggttcttgtaaacggattgggagccacccctcttgacgaacagtatattgtggcaagaaaggtcaatcagattctggaagagaaggggattaaggttcaccgttattatgtaggagagtatgtgacttccattgaaatggccggcttgtccatttcccttttgaaaatggatgaggaactaaagggctatttggatgctccggcagataccccgttctttaagcagggaacagtgtaaaagccatgctgtaaaaaagacagaagccataccattgtcacgattatatatgccgacaatacagcggcagaatggaggaggatatgaaccagcaggaactgatagccatgcttgaacgaataagtaagatcatggggcgaaacaaaaactacttaattgagctggacagtgttgtgggagacagtgatctggggctgaccatgacagatggatttcaggcggcttatgattctgtttcagacgggactgagccggatctgggcaagcttttgtacaaggccgggaaaaccatgggaaataaggttccttccaccatggggaccttgatggcggcaggactgatgcgtgccggaaaggttttaaaaggaaagacggaattgtccggtgcggatgttgccgttttgtttgaagcttatgaagccggcgttgctgatttgggcaaggcaaaagtaggagataagacctttttggatggatttcatcccggcgtggaagtgcttaaggcccaagtggaagccggagcgtccctggaagaagcttttgggaaagcggcagaggcggcatggaatggttttgagcataccacaaccatgatcgccgttcatggaagggctgcaaccagaggagaggcctcccgctccctaaaggatcccggagccgctgtggcagctcttatgatgaaagcagctgcagacagataaagtaaaaccggagcaaacaaaaaaatagtttgctccggttttcatttgtcaatttatagcactgtgtattaaaggcgtaagtcatataaaaattaagccttgttattttattagttcttctttataattaataaacagtaagggggctgaaatatgacttttcaacagcgggttttgtcccatgaattccaactgaatgacaccgatgatttgatcgttgactatatcaatctccacaggaaagagatcatgaacttatctatacggaaaatagcggaagatatttacgttgcgcccaatgccgtcatgagattttcaaagaagataggatacagcggtttttctgagctgaaatatgccttaaacaatgaggatgaaccggaggccggagataagacactggtccatcagctcatggagcatttgccgcagaatattgtgaaaacattggatacgattgacgaaagtgtcattaaaaaagtatccaaaaccttaatcgaggcggactgctgtatatttgccggactgggtgattcctatcatttttgcgaaatgatgaagaataatctccggtgctttgcaaaaaaggtagaatgtgaaattcacattcatgatatgttttactgtgtggagcatggcaaaagcagtgatgttctggttgtcataagcgcccggggagaacatgaacggctgctggagctgacgcaaaaggcaaaggcaaaaggaatgaagacaatcagtatcactcattttaacaagaatccactggctgatatgacggatctgcagctgtttttctggggagagtaccgggttgtgaatgattataatgtaacggaccggtgtggcctgatggtattgctgcggcttctgagtgaggatttctggaatacgtattacatggtttagtttacttatgtatggcaggtattgtttaaatacaatacctgtttttgtgtatttgtatcatatctgcttaaaaacctgtgtgcaaattaccaaaatgcagttttatgaaaaataagtgctatagtgttcttaacaaagaaataaggaggaagggttatgaatcttcaaggggtaacaaatgaaaaattgattgctttaaaccgcagctataaaagcaaggatgaggcaatccgtgatttaattgaaaagctttatgaagaaaaaaagatccggtcaaaagaagagttttatcaggcagtaaaagagagggaaagcttatccgccacgggaattgataagggaatcgccattccccatggaaaaagcaagacggtcaatgatgcggcctttgcatttgcttctgtcagagagcccatagacgactgggagagcttggctccggataacaaagtgcgatacgtgtttttgctggcaattcccgaggcagaggccggaagcacccatttggagctgctggcagaattaatgacaaaggtatcggatcatcgttatctggaacatcttctctcgtccaaaaccagccgggagttttacacaaatctttcttatgaaccggtaaaagcggaaactaaaaagacatatgaaaaaacaatcgtagctgtgacagcctgcccggcaggaattgcccatacctatatggccgcagaagcgctggttcaggcaggggaagaaatgggagttaaggtttatgtggaaaagcagggggccaatggcgtggagggccgccacaccgcagagcatttaaaggaagctgatgctgcaatttttgcggttgatgtggcggtgaaggattcccagcgttttgatcaccttccgctttataaaaccaaagtgtctgctccccttaaagacgcaaagggcattatcagtgcagccttggataaagcgaaaacccaggaaaaaagggagtatacgggaagcagggaagaggataaacagagctttggaagtgaagtcaaacaggcggtgctcacaggagtatcctatatcatcccaatcattgttgcaggcggtatgatcaatgcgttcgcagtattgatagcccagggctttggactgcaggatctttataacctggataacagctggctgtggctgtttagaaagatgggaggcaatactcttggaacactgatgatcccaatgctttctgcttatatggcttactctcttggagataagacggcgctggctcccggatttgctgccggaattgccgcaaatttgattaacggcggatttttatgcggaatgctgggaggcctggttgccggttatacggtgagagccttaaggaagtatatccctgcaaaaggtgtattttcaggattcgtttcgttttgggtatatcctgtgtgcagcacgttgattgttggaatcgtcatcattttcctccttggaaaaccggttgcatggctgaatcagtctctgattcaagtactgggaagtatgagcggatccaatgccggacttcttggcgccattattggaattatggtatcctttgatcttggcggtccggtaaataaagcggcatatacattctgtgtcggtgccatgtcagaagggattttaatgccgtatgcagcatttgcttctattaaaatggtatctgcatttgcagtaacctttgcaacccttggatttaaaaagtattttacccaggaagaaaaagaagccgggatgtccacctggattctgggacttgccggaatcaccgagggtgccatccctttaatgatggcggatccgctacgggtgatcttctctttatgcgccggatctgcagtaacaggtgcaattgtggccatgtgtaatatcggcttggatgtacctggggcaggcattttctccctgttcttattaaaggatggattaggcggacttgccaatgccgccatatggttctttgcggctgtattgggagcggttatttctacaattcttcttgtattattaaaaaaggcaaaattcgagaaacaacagaaagcatagaaaagaaaggcggagaaacgtttggcagatcgtatacatatagttccacattttcattgggatagggagtggtattttactgcggaagaatccaggatcttactggtgcgcgacatggaagaggttctcaccatgctggaaaccagaaaggaatacccctgctttgtcttagatggacagacctcagttttggaagattatttttctgtgaaaccggaaaattatgagcgtgtcaggagactggtaaaacagggaaagctgatcataggtccctggtatacccagaccgatgagatggtagtaggaggggaatccataatccgtaatctgctttatggcatgatggactgtgaaaagctggggccgcgtatggatattgggtatctgccggattcttttgggcagacagcccggctgccgcagattttaaatgggttcggaatcaaacggtgtatattttggcgcgggacctcggagcgaatgggtacggacaaaaccgaattttactgggagggaccggacggatcaaaggttctggtccagcttctgccctggggtatgcaatcggaaaatacctgccaacagagtcggatgagctgaaaacaagactggataaataccttccggtattggataagggagccgcggcaaatgatatactccttcctaacggccatgaccagatgccaattcaaaaagatatttttcaggtgatggaacagattaagaagctgtatcccgaaagaacggtttccataggtcgttacgaagaggtctttcggcgcacagaggaattggaaggcttagatacgcttaggggagaatttctggatgggaaatatatgcgtgttcacagaagtatttattcatccagagctgatttgaaatctgcaaataccaggattgaaaacaaagtaacgaatttactggagcccttgatgagcatcgcatatagtctggggatcccatatgagcatggattaatggagcagctatggaaagagcttttgcaaaaccatgcccatgattccattggctgctgctgcagtgataaagtacatcgggcaattggggaccgtttctttcttgcggaagaacgggccgatcaattaatggatttttacatgcgccagattgtcgacagcatggacagcagcatatctgtggataaacttactgcatttaatctccttgcgtatgaaagaaccgaggtgataacaggggaggttataaccaggatccgtaattttgagctggaagatgaagcaggcaggaggatcccctttgaaatctgcagaaaggaaaccattgatccgggattgattgacagacagatcgtacactatggaaattatgaaccctttgtgaaataccagattgttttccaggataccataccggctatgggataccggacctattttttaaaggaatcacaaaaagagaatcggagtgcagccgggggcactttaacggatgtgatcgaaaacagatattataagattgaagtgttaaaaaacggtactttgtgtattacggataaggagaggggaaatacctattcggaagtccttttgctggaagacggcagtgacgatggggatggatacgattattctcctcttgaagaggattttatggttacaggcaaagacgttgaggcagatgtgaagatccactgcttagaccatatgacaaaagcggtcatccggtattccatgcctgttcccaaaaatctggagagcagaaaaaaaaggagctgtgatgttgtactggatgtgctctggaatatcactttaaaaaaggattccaggatgattgagattacggcggaagtccataatcatgcaaaggatcaccgccttcgggtgctggtccccaacggaatgggagcccaatattctatctgtgacaatcaattgggaatcatacggcggccggtaaaagaccctgggatggaggtttgggaaaaagaaaactggtcagagcgcccggattccatctatcccttcctttcctacgtacacccggaaggtgacaggggaattgcagtcctcaccaattctgtacgtgaatatgagatgacgggccgggagtatgacaccacggcaattaccctgttccgctgcgttggagtgctgggcaaggagaatttatgccgccggccgggaagaccttccggaattaagatggaaacaccggattcccagatgcagggcgtgcaaagatttgattttgccctgacaacctggattccatgtgctgcacaacaggcaaaagagtatatcactccggttgtcacatacaataagatgccatatcatgccatgaaattaaatccaacggaaatcagtgtgccatatcagtatagccttctgaagatagaggaaaaacaattgatcttaagtgcacttaaaaaagcagaaaaagcagaagagctgattctccgctgctataatccatctgaccgcagccttccgctccgcatagattcagaccggctggtctggagtgagtgcaggctggatgaaaagaaaataagggaaagtgcagactgcagttctatagttgtagagcctggtcagatcaggaccctttcggtaaggccggaaaaataatagaggtttcagaaatacaggagcagacaggaaagaaacgtatgctcctgtatttttgtaaataatagacgatttttgtattgaaaaattggggaaaacgcagaaaattttaaaatcggttgcatcaaactgcaaacagtgttatattgtgtctagttgagtacaactaaatagcaaaacaggaagacgtgttactggtaatgcaggcaagatcggattgagcaaagggttataagactgattatttttgtggtcttatgactgagatagcttgatcgggtcttttttattttgttattccggccggatgacaggatattataacacttgaaaggggattgaaaaatgaattataatcaaatagccaaagacatcatagaaaatgtcggcggctctgagaacataagggggcttacccattgttttaccaggctaaggtttcagctaaaggattcaaagaaggcaaaaaaagagataattgaacatctggaaggtgtcatttccgtagtggaaagcggcggtcagttccaggtcgtgcttggtacaaaggtcacaaaggtttacgaagccctccttcctatggtatccttagaggaagatacaggcagcagcgaagaaaaggggtccattgggaaccggatcctcattgccatttcctccatgttcacacccatggttccggcgatcgcggcttcaggacttttaaaaggtttactgaccattgccagaatcacagcctccaatcatgggatggatattacggtcaaccagacttatatcctgattatggctgccacagatgcattgttttatttcatgccaattattctcgcctatacaagtgcaaaggtatttaaggcaaatgaattcattgcaatggctcttggcggcaccatgtgctatccggccgtggtttccctcatgaccggaaaagatgcagtgagtatgttcggaattgccattaccaaggcaagctatgcgtcatcggttattcccattattatcggagtatttattctcgcatatatacagaagtttttagaaaagataattccggaagtattaaagatcatactggttcccggcatatcccttttgatcatgataccggcaacttttatggtgtttggtcccatcggtatctacatcggtaatgccattaacttcatttacaccgggatgatgaatttaagccctgccctgtgcggcgcgtttgtaggcggcatgtggtgtgtgttcgttattttcggggcacacagggccttgcttcccattggaatcaatgatgtggcccagtttggccatcaaaacctgctggcttttgccggcgcggcgaatttctcccagggcggtgcagcacttggtgttatgttaaaaacgaaaagcaaggatttaaaaacagttgcagcttccgcggccatatccgcatctgtctgcggaattacggagccagctatttacggctgtaacctgcggttaaagagacctatgatctatgccattatctgcggcgccataggaggtgccatcatgggtgtgggaggcgtttacggtgattcctttgccaacaatggagtgcttacctttgccacctatgcggcttttggaatgaaaacgtttatttattatctggtcggtgtcggtgtatccttctttggcgccatggcactcaccttcctttttggatttgatgatattacagcaaaggccgggcaagcttccggttcaggaaaagcatcttcaggcgcagcagcggaagaaatggctgagtcacaggatgttttggagatcacttccagcgcagacatactgatcagctcgccggtagaaggcctggcagttcccatgacatcggtaaacgatgaggttttttcttccatggccctgggaaacggaattgccattgtcccggaaaaaggggaagtcgtggctccggaagactgtaccgtgaccctggtttatccgacccttcatgcactggggcttatgctggataacggagctgaaatgatcattcatgtggggatcaatacggtccggctggaagggaagcattttgagaaatttgcggaagaaggcgcccatgtgaaaaaggggaccaggcttctgacctttgacttggatgccttaaaaaaggaaggatttgatacggttgttcccatcatcatcagcaatacagctgccttccgtgaggtgaccggaattaccggagccggggcttctgtggaaaagccggtgatcgcaattaaaaataatcagtaaaggaagatagatatggaagtaaggaaagcaaattttccgaagaatttcttgtggggagcctcctcttccgcatttcagatcgaaggcggctgggatgaagggggaaaggggctgacagttgcagatgtaaactcctttaagcgttcggatatccaggctgacagtaaggttgccagtgatttctaccatcattggaaagaagatatccgtctgatgaaggagctgggactgcagatttaccggttctccatttcctgggccaggatcgtgcctgatggggatggggagataaaccagtcagggattgatttctataatcaagtcattgactgcttgctggaacaggggattgaacccttcattaccttatatcactttgaccttccctatgcccttgttgagaaatataacggctgggagtccagggattgcgtgaaagcctttgaacgttatgcaggcatatgctttaaagcctttggtgacagagtcacctactggcaggtccacaacgagcagaatctcatggtaagggtgaatgaacgggtgaacattaccgcgttggattcatgggaggccgaccgccagagggcccagatggattaccacatgtttctggctcatgccttggcggtgaaagcctgccactgcctcattccaaacggaaaaatcggccccgcagtatcctccacctgtacttatccggaaagcaataagccggaagacgtatgggcggccaggctgaatgactggtttaagacggattattgcctggatatgcattattacggccgttaccccggctattacatggcttatctggaggaaaggaacattgtcccggttatggagccggaagacgaggaaattttaaagggcgcgaagatggattttattgccctgaattattaccgtaccttatgtgtccggtatcttccggcagatgagaagcatccggcgggagagagagcattccccatcaatgaagtggattttgaccagtatggttattttcatcatattaaaaacgaacatctggcttccagcgaatatggagcccagatcgatcccctgggccttcggaccgtattaaataattattatcagaaataccatcttccactcattgttacggaaaacggcctgggagccgccgataccctgacagtggacggaaaagtccatgatgagtaccggatcggctacttaagagctcatatccaggcattaagccaggcaatagaggatggggtccaggtcatgggatattctccatggtcctttatggatttgttaagctcccacgagggctttcgaaagcggtatggttttgtttatgtcaatcgggatgaccaggacttaaaagatatggaccgcgtcaaaaaagacagttatttctggtacaagcgggtgattgaaaccaatggagatgaactctgagtcatataactggctcataactcctgggagcagccgccaaagtcaggcaggtgtgactttggttcgctgctttcgtgagaataacagaaatggggttgggttatgagggttgtaaaagtaatgaataattccctgctgctggcacttgacgacagcggcagggaagtgatcctgatgggcaaaggaattggatttaataagtccattggacatcacttaaaaagtgaagacattgaaaaggtatttgtcttaaaggaccggtcaatttccaagaatatcatccggcttgcatcggaaatagacagcacctattttgaactggccaaacaggtcattgattttgccattgatacttatggaatggtgctgatggaacatatttatctggggcttacggaccatttatcttttgctgtaaaaagaaacaatgaggggattttaatacaaaatttttatacacagacattaaaaaggtttaatccaaaggaataccaggtgggcttatatgccctgcagcttgtgagggagcggctgaaagtggagctgccggaggatgaggccggaaacattgcatttcattttatcaatgcccagacaaataactctgacagtatggataaccagaaaatatttgaaacagtcaagggcattttagatattgtaaaatataatttctccattctctacgatgaagacggcatcggctatacccggtttgtgacccatctgcgcctctttgcacaaaggcttgtaaatggaaaccaggatctctatgattatgaagattccttctacacacatgtgcttgagagctgtccaagggaatatgaatgcgtgaaaaagatcggcatttttattatggaaaaatttgattccaatctgtctaagcaggaagaaatgtacctagccgtccacattcacaggattttggaagaatatgctcagaggaagatgacatgaaacaacagactttaaaggaactgacttttacccgcagacaggaaatccattaccttgccatggtatcccttttctggtttgcccaatatgtgtatattccgtatcagaccacttttttgactgcagttggagccggcagcgcatttaccggaatgattgttggagcctatggaatttcccaattgctattaagatttcccatagggctttgtgcggattccgttggcaggcataaatattttattatggcaggagctcttgcatcaggaacggcctctgttttccgggtattctggtgcaatggcaccggttttctggtggccaatcttttctccggactggcttccgccatgtggatctcttttatggtgttttacaccagccatttttccgccagggatcagcaggcggccaccagccggatcgtgctgttcaacaattttggaatgcttctcggtttcttatgcagtgcggtaagttatcaacggataggcatggccgggatctgtatattgagcatctttgcaggccttttggcttttctcctttcagcagggattaaagaaacggatgtccatcccggcatgcataaaaccagggaactgctttctgtttgtaaaaataaacgtttatggatgttttcttttgcagccctgatccagcaggggatccagctgaccactgccatgtcatttacaaaccagatattaaaatcattgggagcgtccaatgggatcgtagggatttcctcagtcgtctatatgatgtcggcagtagggtttgcggcctttgcagcttccggcatctgcagctccagggggccaaggttctggatccctctggtatttggagttgtggccttatattgtgtgctggttccggctgcagggagcatccctgtgcttttgctgctgcagattttaccggggatgtccaccggtatcttgttttcttttgcaacctctgaagcaatggaggagattccggcagaaagtaaatccactgccatgggactgtttcaggccgtatatgcgttaggaatgaccacattccctgtttttacaggggcactggcctctggtaagggaatggagaccggttatgtgcttctgggtgggatagcctgcctgggaggcattgtggtggctttgttttataaaagaaatgctgccgatcatgggatcggcagctaaagcttttttattcttcaattaacccgctcatcaaattgcggctattctttgaaacattttgtatacgtctatttgcccgtacccccagatattattgggataagtataggcgtcgcttcgatatgccccccgcatcatcatgtgattgatctggagccctgtgacggctgtgtgatttcctttgcagaacccccattccaggaccatggctgctgctccggctgcgtgggccgccgccgcaccggtacctgtaatacttccatacaggcctccggggagggcacagggaatgtggtagccgggagcagcaacatcgggaacgatctcacccaatcgggaataacctcttccggattcttccagaatgctgtcgtcaaactggttataggcagcaactgtcagaggatttcgggcatttccgggggctgttatggtggtgtccgggcttgagtggtaaaaatatgtttcgtttgagatcaaatttcctgacggaagccaggcatgaaaggaaaaaggctcgctttcaatgctggaaacctgaaaataccagattccgtgtgtgggattgtcaaaacgcactaagatgagctgatccccggtagatccctccaaaaggctgttgttgatccaaatggtagtttggccaaaggaaaggttgaatttttggcagtccctggaagaaggaggtatgcttcgaacgatttcccggttgggtgagaaaatttcgatggttattttaccgggaggaaagggccagatttccatggagaattttttgtcgttttttcctatttttaaattaaaatcattacaatagggcgatgctgctgactgatagaaatagtgtctgcggttctttccttcatttcctgccgccactgatacgttgatttttggaagctgtacgatctgatccaagtaggagctgagggcaccctgcccgccatggccaccctggctgcttcccaaggcaatgcatatgacgatagggtggtctgttttttgtgcaacggagagaagataacggattcccagcataatatctgattcctggtagcacagggagttttccggaacaaagaacagtttttttaaattctgttttgcttcttttaattttacgaccacaagctctgtctggggaacaacgccggtaaaggattgtttttcattagcagcaccggaggcaatgctggcgattgctgtgccgtgtccattggtgtctttcgtaggaacaatggacagaggatcgtatgatctcaacgcagtatttatgtgatttttgctgtattccgagccgaaactaaaatcttccggaggcctgccgctttggtcggtctgatcccatatggatagaatgcgggtggtgccgtcataatttttaaatgcaggatgctggtagtcaatgccggtatctatgatgccgatgagcacccccagccccataaggcttaaatggggatgtttgcgggtattgcagatgcctgatctttcaatgcttaccttagaggcaagagtgaaaagagaggggaaattatcgtaaggatacaggcctaaatcgcaggcatccatattatttttctgtatatgaatcaaagaataattgtcatttaaaacagtaatattatccctgtcaaaacggggaaccaaagagttgcttacaatcaaatcataatattcattatcaaatattttattcatgagaaagcccccaacctgctactttagacgcagtatatatttatcttatgcatggatatgggggttcatgaaaggttatcagcctttgggaagctccaggtccttaaaagagttgaagaaaaccgtatgttctgtatcaaaccgcttttcgtgataggggctgggggtgcagtcttccctggggtagcccatgggaagcagtaccacaggaattaaatgttccgggatgtcaaaagccgcacagatggctgcgggatcaaaatgaccaacccaggtactgcctaatcccaactcagatgcttcaagcatcatttgtgtggctacaatgccggcgtcaatgtctcccatgtccttattatcgtaagatctcttccagctgaccgtggaatcatagcataccagcagagccagaggggcatgaaaatgataaggagtgcagggttttaatttggtgagattttccgcgctgtcaatgacaaggatccgctggggctgaaaattcactgcagtaggagcgacccttccggcttccaggatcagatccaacttttccttttctattttgcggtcgctgaatttcctgacggagtaacgttcttttgccaattgtaaaaattccataacaacatctccttctgtttttttatatccttactatagcataaaagggaagcagagcaaagtgtccagtgatttttcagtcactttctacaggaggggattctttcgggggctctttaccatgaaaaaagacggaaccaatccataggactgtccgtctttttatgatatacatttagctgagaggagtagcttttcctgtcccttcgtcatactgaaaagccacgctgctggtgttataatcaaacaaataagaggcaacataaatcagggtgttatcaggctggcgcttatatgccctgaccgtataataattcttcccgtctattttagataatccaggtgatgcgatatattcataagattccacggtttccggcagacctagcttttcctggctctgggcgcggactgtttcctctgcctgttcaatggtattggtggctttcggctgtttttcaaaatccgcaattatctttttctgctgcttccactggtctttaaaaaaggtgttccagggcttgtcttccttacatgtagttaccgtatagctgtcagcttcagattccagggtaatggaaaggtaggaagaggagtctttggagggaccggcaagtctgtagatctctgtgccggctttttcagtttcttctgtggaagtctgttcttcctgaagggatttgtccgttacatcaatgaaattttttactccctctaaatagtccttgtagctttttaaatcagcagaggtgtcttctacatgaaagtacttgtaccggtcctccgggccggctgcttgtgtggaggaaggagcagaagattctctggctttttgtgtctggtcatcggtttcttttgtttccgtttcctggacggcttcaacagccggctgcttttcaaaatcacgttttcccacgacttccgttacggaagaaattccttcatcttttgaaaagtaataggagggcgcctgctgcacctgttctttcgtggtatccttcttttttgcggtgagcaaaatgatggcctgggcagatcctataatcatgatcatcagagccgctaccagcaaaaccaggacccttttatttttaggcaataggcttttccctttggcttttggagcttttgctggttttgccttcacttttttggcctttgcggcctttactttttggggttttgtcttgggagctttctcttttttgttttttataaattttggcataatgatcatccttgtgtatttactgatgcggaatacagatcaaatggctgcttaacatcgctatccatatatcggttaattcctttagaaaaataaggatttggaataaaattgattttgtttacacggcaagaagcttttttgcagttcccataatcactttatcaacaaattcggccacttcttccttaggctgctgcatatccgtatcaagccattgttttagaacgcccgtcagcccgtaggtaatgaattcaaggtaataatttaaggtcacttcctttgcatcaggatactgttctttgatgattgccgtaccgttttttaagaccagggtatggaaacggtttacgaaatcattggaggagctgttctcaaacaggatcttacatatctttttattctcctcaatataatgaatgattgggatgacaacgggcaggagcgagtcctttttaaaagcatagcggcggttgctgaccatatcctgaaaatcatttaagacttcagattccatctcctgcagcaggctgtatgtgtcggcgtagtgaagataaaaagtaccccggtttaaatcagccagttccgtgatgtcttttacggaaatattcttaaaatctttcttttccatgagttcaagaaggctctcctttaacagcttctgggtttttcggatgcgtcgatcctgtttttgtgtttccatatcattcctccaattgtgattctatgcttgcttctcatttcagaccctgaaaattatgaacattatggcaaaaagtgttgagtactgcattaagaaataacttgtgactgttaatagaattatcgctaatgattgattattgaaacttatttacaagagtattataatgtacacgtgttcaaaagtcaataatgtatctattagtagaatcaggatgggtaatggaggaagacatgaaaaaagacaaaagtttatttgacagaatcgtgcacgtgattgtattctgtgggaaggaaatagaggcctttttctttcttgcgaccatcatctgtgcagtttgttttccttttgtaaaggtaaactacgatttaagcaaatatctgccccagtttgctcagacaaaacaggctctcgatgtaatggaggatgagtttgggtaccctggcatggcccggatcatggtaaaggatgtaagccttccggaagctaagagaataagagagcagatatcggatctggaaggggtggacctggtcataggcccggacctgaccactgatgtgtatatgggggcctcctttgtgaatcagggaatcacagatatgatgtcagtggatgctttttccatggaggattactaccatgacggatatgcactgatggatgtgatctttgaaaatggtgatgacaatcacctgacccgtgaggcggtggaccatatttaccgcattgtgggaaaggacagaggctcttttgccggaagcgctgtatccagcaaggagcgtgaagagtccataacaaaggagatcaccatggcgatcggaatggctctggtgatcatctggcttatattgacccttaccaccacgtcctggatggaaccgtttttgtttatttttgtcatgatcgtggccatcatcatgaatatggggtctaacctgatgttcggcaccatatcattttttacattttccacggcagccattttacagctggcagtatccatggattattctattttccttttacatacttttacggcgatcaagaatacgggtattgaaatacatgaggctatggagctggcggtaaaggaatcctgcagttccattctggccagcggggccaccaccattgtagggtttcttgtgatcgcatttatgcgttttaccattggcaaggatgtgggatttgtgctgaccaagggaatcctctgcagcctggccaccgtactgttcctcatgccgactctgatcctgcactttaatgataagattgaaaaaacggcccataaaccgtttcttccttcttttgaccggtttgcaaaattgatgaacaagattcggaagcctgttttcgttgttgccatttttctggctgttccctgttactttggtcagaatatgaacgttttttattacggagatgatgccattggagccggaccgggaaccagggtatatgaggataccagggcaatcaatgaggaattcggaaaatccaacatgatcattggcatagttcccaacggcgacctggttacagaagggcagctgacggattctttagaggacctggattttgtaaattacgccatatccatggcgggaacagtgcccaaaggaattccggaaagctttcttccggaaaaggtgagcgagcagcttagaagtgagcggtatgccagacttttgatatccttaaatacggtccaggaaagcccgtatgcctttgaatgcagccagaagctggaaggcgtgatcagggaatattatccggaggatgcttatgttataggcatgactcccacaaccattgacatccgcgacatattgaccgatgactataataaggtatccttattatcattggcgggagtggctctggtggtttttgcgaccttccagtcggtcctggtcccaatccttgttatcatacccattgaggtggccatttatttgaacatgacactgccctatgtgctgggggacagcatggtatacattggatacatcatcgtaagctgcctgcagctgggagccaccattgattattctatcctgatgaccaacaattatctgggtttccgtaaaaccatgaataatacggattccgccatgtccgccatttcaaaaagcaccctttccatactgacgtcaggcgggattcttacggtcgtaggttatctattgtattttacatcgtccatacaggccatttcccaggtgggacgcctggtggggaggggagcggtcttaagtatggttctggtgctttcccttcttccggcgcttttaagcacctttgacaagcagatccagaaacagcagcggaatgcggcaatgaggaaggaaaaacggcgtttaagatatggaaaagtgaaattaaaaggagagaatgaccatgaaaaagtataatagaatcctgagtatgggcctggctgccatattctcccttcagccggttctgtcggccctggccgcgccggaagtgccccagtatgatgaaactctttatgtaaccatggatccttatggagaaataaaggaaagcagcatcgtaaaaaattaccagatgaatggaagcagcaaggtggtggattacggtgcttatgagaaggtaatgaacttaacggatcattcggaacctgttttgggagaagacggttccatcacattttctccggaagagacgggaaaacggttttattttgaaggcaggacccagacagagaaatcccagcttccctgggatattaaggtgagttaccgtttaaatggggtggaaaaaaaggcggacgaactggctggagaaaagggattaatcgagatcaatgtggatctgacccccaataaagggctctccgactactaccggaataacatggccctaatggccagcacagtggtggatatggataaaaatctaagcctggaagccgagggagcacaggtgcaggctgtgggaaatttaaatatggttgctttttttcaactgccgggggaggaaggccattattccatccgcatcggctctgaggatttcaaattctccggcattgtctttgccatggtgcctttgacagtaagccagcttgaaaaggtcaatgatttaagagatgccaaggaaactgtggaggattcggcggatgccatcagcgacagcctggatgtggttttgaataccatgggcaacatgcaaaaaagcattgaagatacggcagacggcatcagagggctggatagaaccaggcagatatttgctgattccaagggcaaggtgtatcagaatgccgacgaggcactggcagctcttgatggcttatcccagaccctgcgtcccttttataatcacactcaaaacgccggaaatgccttgaatgatatcagaacccagacaaaccatacggtggaaattcttgatgatttatcaccggacctgggtgatttgcaggacagtgtccggcatttgcgaaatgaggtggaagagctgcggaaaatggcaaaggactcccagacggatatgaaatcccaggcctttctcgggcaggcaaaaaagatagaagagcgcttaaataccctgacaactgagcagcagaagctggcaaaggagcttgcttcccttggacagtcccttcctaagctggctgcactgaacagtactctcagcaaatcggcggcaggaattgaggctgaggaattacaggacttaatccaggaaatccaggatgaagggcttatggatgaagatgagatatcctcctacctgtttaatgaaaaggactattcccttccggaaatcaatgcgctcactgcctacctgtcctccgcactggaaagcggcaacacagcaactcccagcaatgggtctaaagccgcggtggaagcggccgctcccctggccgcccttcttccccagcttgccgacagcggtgcaggactgacgggagatctggcaaaaatgcttgggatgacccagatgctggtggcagatttatattccttaagaggccctgtaaacggggcatttgacggagctatgggcatagcaactgcagcagggaacatctgtgacactgccgatgatttaatcagcgctgccgatgaattaaatggtattttaaaccgtcatcacgacgaaatgattgccactttaaatgatgtcggaaaaatgacagacagcgcatcaaggggcattgattccatgaatgtatttttccggtcaatggaaagccagatgaagaccgtgggagattctttaaacggaagcacagaaaaaaccttaaacggtctggccggcgctttggatgaggcgggaaatgggctgaatcagaccgatgtattaaaaaacgcaaaggataccattaagggaatgatcgatgacaaatgggatgaatatacaattgataagacgactattttaaacattgatacagaagcttctcctgtgtccataacatcggcaaaaaacccttctcccaggagtattcagatgattctgcgtacagaggaaataaaggataaaaaggataatgctgatgtagatgtggatgaggatttttatcctgatggaaacatttttcatagaattggaaatatttttaaacatatctggaggtcaatcacctctgtttttaagtgatggtatgacaaactgttggtgctttgctcaccgtggtattatgagaggtcatgaggacaaggcttacgtccggattgagcaaagttctggtaatcagctgcgcggcaggatgagaaccggaatataacggatatgtgccggaatcaacagaaggaacccggatgcggattcaaaataaaagagttttttgtttatttaaggcagcggttaaagagagggggcaggattttctctttgactgctgctttctccggaatattttaagaattgtcacaagtttccatgatgctgatttgaaaaaacagaacatacattcgaaaaaagggcttgaaaaaacagtctgcttatgttacaataaagcaaaagaacatgtgttcgaggtggaaaatgctgattcaggaagaattaagtgtacaggaaaagcttgaaatattatcagatgccgcaaaatatgacgttgcctgtacctccagcggggtagaccggaaggggaaggcagggactcttgggaatacgacggcgcccgggatctgccatagcttctctgcagacggcagatgtatctctcttctgaaaatattgtttactaaccagtgtatttatgactgcaaatactgcatcaaccgatgctccaacgatgtggtgagaactgcgtttactccggaagaagtgtgccggctgacgattcagttttaccgccgcaactacattgaagggctgtttctcagctcaggagttctttacagtgcggattataccatggatctgatctatcagacccttaaaaaactccgggaggaatatcatttccacggttatatccatgtaaaggccattccaggggcagacccggttctcattgaaaagacagggtttctggcggaccgtatgagcatcaacctggagcttcccacggctgatgggcttaagaagctggctcccggtaaaagcaggagcaagatccttacgccaatgaagcagatacaaaaaggcattaaggccaatcgttacgaactgatggaatacaggaaagcaccatcctttgtgcccgctggacaaagtactcagatgattgtaggtgccactggagaaaatgattttcagatgaccatggtggcggaggctctttatcagaattatgatttaaaaagagttttttattccgcatttgttccggtcaatcaggacagcagcctgccggctcttcccggaggaccgccccttttgcgggaacacaggctgtatcaggcagactggctcatgcgtttttatggatttcgtgctggggaattgctttctgaggaacgccctaattttaatgtgcttctggatcccaagtgtgactgggccttgcgccatctggaacaatttcctgttgaagtaaatagggcagattattatacgctgctgagagttcccggaatgggagtgaagtcagtaaaacggatcattgcggccagaagaaacgggcctcttgattttgatgctttaaaaaagatcggtgtcgtattaaagcgggcgatttattttattacatgttccggcaggatgatgtatccggtcaagattgaggaggattatatatccaatcacctcattggagaggagcagaaaaaaatatgggacatcggttcaacgggaacgtttcgtcagctttccttgtttgatgacatgaatttgcctgctttgagagattttggaggaatccggatatgaagacagtctatttgtgtgaggacagcgtggaaggcattttcagcggtgtatatgcagcgtggaccagcaggaagggacatgatcatgtgaagcttggtctcctgggaaatgaggataccatggagctgttctgccagtatgaggaggttccggtcaatgccggcaatgcggataaggtggtacaggctgtcaggaaaaagatatcggaagaggcctatgctgccgtatacaaagccgcattaagcaaggaaagagatcgtgcggataaaatttaccgttttttgatttatggtttccacgttggggcaagagttgtgaacatgcttcagatccaggaagtatacgatatttttcagatgtgccgtcatattgataatgagacccatctgcttacgggcttcgtgcgctttgtggaaatggagggggatcttttggtgagccggatcggcccgaagaatgatgtgcttgttcttctgtctcctcatttcgcggaccgcatgtcaggagaaaattgggttttatatgatgaaaacagaaaaaaagctgttttgcatccggctctgcggccatggtttttggtggatttaatttcgtctgaatgggaggagaaaatgcaaaaagcgtcggatgaggatgaatatgaggtgctttttcaaagcttcaggaaaagcatttcaataaaagagaggagaaatccgacttgtcagcgcaatcacatgcccctccgttacagggcatatatgcctgagttttcccatggcttaagggatctttgactcctgggatgtccttgttatataaggcgggatcatggaacgggaaaaaagcattgcctttttcccttttttcggttatcataaatacaggttccggttcaggaacattccagatgcgtttctgcatattttccaggtttattgttagtgaaacagaagtatgaaataccctgcgggtatacctttacaccggtgaagcggggcggactctgtccagaaagcatgggcatacataggaaaggagaagcggttttgtacagtaaagtccatagtgtgggtattaagggagtagaaggggtccccattctggtggaggcggatgtcagtgacggactcccaggcttttccatggtcggttatctctcctctgaggtgaaggaagctcaggaccgggtgagaacggcactgagaaattccggattccgcctgcctgcaagaaaaatcaccattaatttgtcacctgccgacatacgcaaggagggaactgcttttgatctgcccattgcggtggctgtattgactgctgccggcatgatagaacctgttgccttgggggattgcgtgatatccggggaattgggcttagatggagagatcaaacctgtacggggtgctctttccatcacagcggctgcaaaaaaggacggaaagcgtcaatgttttctacccagtgaaaacgtcagagagggcttagtaatagaaggaatggaaattattggagtagatcatttaaaggatttaaccgatcagcttaattttccggaaaagcaaaaagcaggctgtaatagccaaggcagactgatgcatcaggaggaagtctatggagttgacttttctgagatcggaggtcaggtacttttaaggcgggccacagaggtggcggtggcaggtatgcacaacattgtttatatcggtccggcagggaccggaaagactatgctggccaaaagaatcccaacgatcatgccttccctgtcaatggaggaggctgtggagatatcaaagatatacagcgtatgcgggcttctttcccaggaaaatcccttgatgacaaaacggccctttcgaagccctcatcacaccatcagtccgacggctttggccgggggaggacggataccaagaccaggtgagatctccctggcatccggaggcgttctgtttctggatgaattacccgaatttgaaaaaaataccatagagatcttaaggcagccccttgaggagaggaaaataacgatttccaggatgtacggcgcatatgattttcctgcggattttatgatggctgccgccctaaacccttgcccttgcggtttttttccggaccggacaagatgcagatgttcggaacaacaggtgcgcaaatatttaagcaaaatatcaaaacccctgctggataggatcgacatatgtgcagagtcccgggcggtcacatacgaagaactgcaggaaagaaaaggcggtgaatcctctgcttccatccggaagcgggtggaggaagccagaatgattcaaagaaaacgttttaagggtcaggggatatattttaacagctccatgaataaggttcagattgaggaagcatgctgcctgggaaagagagagcaggagtttttaaaaagagtttatgaaaatctgggccttagtgtgagaggctacgaaaagatactgaaggtatccaggaccatagcggatttggagggctccgaaaaaataagaaaaaaccatttagcagaagcggtgggactgcgcagcctggaaggaaaatattggggagaaatttatggaagatcatgaagaaaaggagtatttatattggctttgtcatgttcccgctttaggcgcagtgaaaataaaaaagctgtatgattacattggaagctacaaaagaatatataatatagaaggaaaagagctggaacgttcagggcttttaaaaccggcagaagcttcattttttcaggagatgaaaagaaacagggattcctgcagatcagagctggcggggctggaaaacagaggaattcgttttgtcacccctcatgacagagaatatccaagacggcttctggaaacatatgggtatcctatgggaatttttttcaggggaaagttaccggaagatgacaagccttcggctgccataatcggagccagaaactgcacaaattatggaaaacaaatggcctcttacctggccagggagctttccgcggcagggattcagatcatcagcggcctggcatggggaattgacggagccgggcatttaggagcgctggaggcaggcggggacacttttggagtcttaggctgcgggatcaatatctgctatccaaaggaaaattttggattatatgaacggatggctgtccagggcggagtcattacggagtttatgccaaatgaagcgccaagaccctgtaattttcccatgaggaaccggatcatcagcggactgtcggatataattttagttattgaggccagagaaaaaagcggttcccttatcacggtaaatttaggacttgaacagggaaaagaaatttttgcccttcccggaagggtgacagatcccttaagcgccggctgcaacaggcttatttctgaaggtgccggaattttgttagaccccggttctgtgctggaatatttcaaattacagagtggtaatatattaagagttcatgaaaaagataagaacggacttgtcaaaaatgaaaaaatggtgtatagttgcctagatttgcaaccgaaaaatctggaagagattatatctttaagcggattgtctgtcagcgattgtatgagcgccctgttggaattagagtttaaaggccgtgttgtacagacgtcccatcaatattatggtaagaaactataggcgaggagtttggtatggcgaactgtttagtaattgtggaatcaccggcaaaggtaaaaacgataaaaaagttcctgggagcgaactatgaagtagatgcttccaacgggcatgtgagggatcttccgaaaagccagatgggaattgacgtagagaatgattttgatcctaaatatataacaatcagaggaaagggcgatattctggccaagctcaggaaagaagtgaagaaggccgataagatttatcttgccactgaccctgaccgggagggggaagcgatttcctggcatttaatgaaagctttaaagctggatgaactgaaggaaaagcaggtataccggatcagctttaatgagattacgaagaatgcggtaaagacttctttaaagactccaagagcgattgatatggatcttgtggatgcccagcaggccagaagggttctggaccgtatggtgggatatatgataagtcctctcctttgggcaaaggtaaagagaggtttgagcgccggccgtgtccagtccgtggcgctgcggctgatctgtgaccgggaggaagaaatcaacgcgttcattccagaggaatattggaacctggaagctgttttaaagcagggaggaagcaaaaagcctcttgcagcaaaattttacggtgacaaagacggcaaaattgccatccggagtaaagaagagctggaaaagattctggcaggtcttgaaaaccagacctatcaggtggaggaggttaaaaatggagaaagggttaagaaagcccccataccgtttaccaccagcacccttcagcaggaagcctccaaggtactgaatttttcgacccaaaaaaccatgcgtttggctcagcagctgtatgaaggcgtggaagttgcaggacgaggaaccgtgggtcttatcacctacctaagaactgactccactaggatcgcggaagaagcggatgttgcggcaagggaatatattggaaagcagtatggcagccagtatgtggcaaatggagaacaggcgaaaaaaagcaatgcaaagatccaggatgcccacgaggccatccgtcctacggatatttctctgacgccggttattgtgaaagaatccctgcagcgggatttgttccggctttaccagttgatctggaaacgttttacagccagcagaatgcagcccgccgtttacgaaaccacttcagtcagggtgggagccgggaactatgttttcacgctttctgcctccagactgtcctttgacggttttatgtccgtctatgtacaggaggatgataaggaagaagccaatgtattgctgggcaatctggtaaaaggcagtccccttaagcttgataaacttgagagcgggcagcattttacccagccgccggcccattttacggaagcctctcttgtaaaggcaatggaggaacagggaatcggacgccccagtacctatgcccctacgatcaccacaatcatagccagacggtatgtggcaaaggaaaataaaaatctttatgtgacggagctgggagaagtggtcaacagtatgatgaagcatagcttcccaagtattgttgatatcactttcactgcaaatttagaatacctgcttgataaagtgggagacggatctgtccagtggaagacggttgtgaagaatttttatccggatttaaaagatgcggtggataaagcccttgtggaattggaaaccgtgaccattgccgatgaggtgacagatgagatctgtgagctgtgcggacggaacatggttataaagtatggccctcacgggaaattcctggcttgtcccggattcccggaatgcaagaatacaaagccttatctggagaagatcggcgtgccttgcccgaaatgcggaaaagaagtggtaataaagaaaaccaaaaagggaagaatttattacggctgtgaggcaaatccggagtgtgatttcatgtcctggcagaaaccttccaccaaaacctgccccaagtgcggagcttatatggttgaaaaaggaaacaaattgctttgctcaaatgagcaatgtggatacagtgctgataaataggaaaaagaaatattattaagaaaatcgaaaatcttcaaaaaactattgttatttgaaaataataatgttaatatttaatcattagagatgtattttagtttttcacataaattcttaaggaggttttcggctatgagcgtacagttgttggacaaaactagaaaaattaacaaattattgcataacaataattcgcataaggttgtatttaacgatatctgtgaagtgctgaccgagatcctgaattcgaatattcttgtgatcagcaagaagggaaaggtgctgggcattggcctgacaccggacatcgaggagattcaggagctgatcgcggaccaggtaggcggttatgttgatacgatgttaaatgagcgtttgctcagtattttatcgactaaggagaatgtcaatctggaaacgctgggtttcactggtgacgatatcagaaaataccaggcaattatcacaccgattgatattgcaggggaaaggcttggaaccctgttcatttataaatccaattcccaatatgatatagacgacatcattttaagcgaatacggaaccacggtggtagggctggaaatgatgcgctccgtcaatgaggagaatgcggaagaaaccagaaaagtgcagattgtcaaatcagcgatcagcaccttgtccttttctgaattggaagccatcacccatatctttgaggagctggacggcaacgagggcattctggtagccagtaagatcgctgatcgtgtagggatcacccgttctgtcattgtaaatgctcttcggaaattcgaaagtgcaggagtgatcgaatccagatcttccggaatgaaggggacttacatcaaggtattgaatgatgtggtatttgatgaattaaaaaccattaaagccggaaccattaaaaatatgcccgaacgccgggatataaaagatatataaatcaaagtcaaaagaaaaaggagcagaagaaaaactgctctttttttaataaaaatcattgtatatccagttgattcattaatacacaaaatatggtaggatatgtttgttttgcacataaagtataaaaaaatacttgcatcgtgtagaaagatatgctatactggctaggctgacaaaaaacacgtctgcggatttcagaggatggtgccgggtaccggtctccttggaagcatgagaagcaggcggaagtaaaaaccaaatggaggtagtaacatgagtgttatttcaatgaagcagcttttggaagctggcgtacacttcggtcatcagacaagaagatggaaccctaagatggctccgtacatttacacagagaggaacggcatctacatcattgacttacagaagtctgtagtaaaggtagatgaggcttacaaggcagtatccgatattgctacagaaggcggcaagattcttttcgtaggaacaaagaagcaggctcaggatgccatcaagtctgaggcagagcgttgcggcatgtatttcgttaatgagagatggcttggcggaatgcttacaaactttaagacaatccagtccagagttgcaagattaaaacagatcgagactatgtcccttgacggtacatttgatgttcttcctaagaaagaagtaattgctcttaagaaagaatgggagaagttagagaagaacttaggcggaatcaaggaaatgaagaagattccggatgcaattttcgttgtagatcctaagaaagaaagaatctgcgttcaggaagcccatacactgggaattccgttaattggtatcgctgatacaaactgtgatcctgaagaacttgatttcgtgattccaggcaatgatgatgcgatcagagccgttaagttaattgtatctaagatggcagacgcagtgatcgaggcaaaccagggcgaggcagtagctgaggaagcagaagcagctcaggaaacagaagagactgtggaagcttaattattcaggcgattaaatgcttcgacctgctttgagaaagcgggtcggagcttttttactggaaaaaagttcctgtgaattaaataatgaatcaattgatggagggaaatcaaatggcagcagttacagctggaatggtaaaagaattaagagaaatgaccggagcaggtatgatggattgcaagaaagctcttgcagagacagatggcaatatggaaaaggcagtggagttcttaagagaaaaaggacttgcagctgcttccaagaaggcaggaagaattgcagcagagggtatcgtcaccacgatcgtgacagaagacggaaagtctgcagcaattgtagaagtaaacagtgagacagactttgttgcaaagaatgctcagttccagggatatgttgcagatgttgcagctcaggcacttgcttcccagtcaaaagacatggatgcattccttgcagagccttgggcaaaggacagctccttaacagttgcccaggtattgtccagccagatcgcagtaatcggggaaaacatgaacatcagaagatttgaaaagatcattactgacggtgtggttgttgattatatccacggcggcggaagaatcggtgttttgatcgaggctgatgcagaagttgtgaatgatactgtaaaggaagctttaaagaatattgcaatgcagattgcagcgttaacaccaaagtatgtaaagagagatgaaattcctcaggaattcattgatcatgaaacggaaatcttaaaggtacaggctaagaatgagaacccggataagccggacaacattcttgagaagatgattgtgggccgtttaaataaggaattaaaagaattctgtctggtagaccaggcttatgtaaaagacggagatttaacagttggcaagtacttggagcaggtttccaaggaagtcggcggcaaggtagaagtgaaaaagttcgtacgctttgagactggtgaaggtcttgagaagaaggaagagaactttgcagaagaagttgcaaagcagatgcagtaatcttgtaacaggattctggggggaatcccatgggtatccatgggatttttctattcaatcaatgtccgtttaccattgacaaatgtttccataataggcggacatcactataccaaaggagttgaggaaagtggctaaatatattttaaagcgtatcgctatggcgattgtaaccatctttgctgttgcaacggttactttctttgtcatgaacatggtgccaggcggccccttcatgtctgagaaggccatcagcccacaggcccaggcggcccttaatgaaaagtacggcctggataaaccgttaggtgaacagtatgtaacctatatgaaggatctgcttcatggcaatttaggattgagtgtaaaacagcgcggccgtacggtgaatatgatcattgaaacaaagttcccggtatccgcaaggatcggcgggatcgcgattctgaccgctgttttagtcggagttcccttaggcagtattgctgcattcaagagaggaaccgctgttgacaatattattattgtgttcagtacatgcggcattgctgtaccaagctttgtagtctgtaccatattaatgtatgttttgagcttaaagctgggactccttcccacatttggactggcatcgtggaaaaattacatcatgcccgtaattgctttggcattttatccctcctcttatatcgcacgtctgatgcgttcatccatgctggatgttatgggacaggattatatgagaacagcccgcgccaaggggctttcccagatggtcagcatttttaagcatgcgcttcgtaatgccattcttccggttgttacatacttaggtccccttttagcctataccgtaacaggaagctttattgttgagaaaatatttacgattcccggcctgggatctgaattcattggttccattacaggacgtgactatcctctcattatgggcactacgattttccttgctactttaatggttgtcatgaatgttctggtagacgttgcttataaattcatcgatccgcgaattaatctgaagtaagggaaaggagaaagaagatgccaaagaataaattatcaatgcagcttaatgtggaagactttctcccggcaagcgatgcagaaaaagaaagcctgactgttatgcgcaaaagcgttggattctggaaggatggaataagacgccttaaaaagaacaagatttcaatgatcagccttgctgtaatcattattgtatttattttgtcatttattgtgccgcagctctacccctatagctatgagcagcagatcaggggaagtgaaaaccttgctccaatgcagtattcccaaaaggaactgactgccatggatgctggagaagatgtatttcctcatattttaggaacggataacttaggcagggattatgcgatccgtgttatgatgggaagccgtgtttctctgatggtcggtctgatcgcttcctgtatcattttacttattggctccctatatggatccattgcaggtttcttcggcggatgggtggatatgattatgatgcgtatcgtagatatgatctatactgtgccggatattctgattatcgtacttttatctgttgcttttgaccagcctttgaaagcgttgtctcaaagacctggttttcagtggatccaggtcatcggcgttaacttaatcagtattttcgttgtgtttgccctgctttactgggtaggtatggcacgtattgtgcgaagccagatcctgattttaaaggaacaggaatatgtaactgcggcaagggcccttggcgcttccagcggtcatatcattaagaagcacctgcttacaaactgtatcggtactctgattgttacgactacgctgcagattccttcttctatttttacggagagctttttaagcttccttggccttggcgttgctgcgcccatgccttctttgggaagccttgcaagcgctgcgttaaatggtctgcaaagctatccacaccgtttgtttgcaccggcacttatgatttctatcattattctaagcttcaacctgctgggcgatggtctgcgtgatgcattcgatccaaagctgaaagattaaggaggagagattccatgaacgaatatttggttaatattgaaaatgaacgtctttccttctttaccccggctggagaagttaaggctcttaatgatgtatcccttcatcttcgtgaaggagaggttcttggcattgtaggtgagtccggttccggtaagtctgtaacagcctacagccttatgggacttacggcttatcctggacggctgattggcggatctcttcagtttaacggccaccagattgagaagatgacagagaaggagatgagaaagatccggggaaatgaaatttctattattttccaggatcccatgaccagcttaaatccggtttacacggttggaaaccagatcactgaagtggtcatgcttcatacaaataaaaacaaacagcaggcgaatgaaagagcaagggaacttctaaccctggtagggatcaatgagcctgataagcgtctgaagcagtatcctcacgagctgtccggcggtatgcgtcagcgtatcatgattgccattgctcttgcgtgtgagccaaagcttttgatcgcggatgaaccgactaccgctctggatgtaaccattcaggcacagattctggaactgatgatggaactgaaagaaaagcttgggatggcgatcatcatgatcactcatgacctgggtgtggttgcgaatatgtgcgaccgaattgcagttatgtatgcaggaaaagtagtagaatacggcgatacggatgatattttttataatcccagccatgaatatacaaaaggcctgatccgaagcattccgaagcttacagagaaagaacacaacaaactggttcccattgaaggaagccctgtagatatgctcaatccgcccgcaggctgtccctttgcgcccagatgcagggcctgcatgaagatttgtcttcgtgagatgccgccatatacggacatatctgatattcattacagtgcctgctggctgcttcagaaacaggaatatgaacaggcgcagaagggagatgcatgatggaaaataaaaatcttgtagaggtgaaaaatttacagcagtatttccctgtcgccggaagcaaattatttgagaaaaaggtagtaaaggcagtagataacgtttcctttggaatcaaaaaaggtgaaactctgggactggttggagaatccggctgcggaaagaccacaacaggccgtactctgctccggctttacgagcctaccgcaggaaagatcttttttgacgggcaagatattacaaaggtaaatatgcttccttaccgccggaaaatgcagatcgtgttccaggatccatatgccagcctggatccccgtatgaccgtgggagatattatcggtgaagccatcgacatccatcaccttgcttccagcaaaaaggaccgtcaggatcagattatttccgttctgtcaactgtgggacttaattcagagcatgcaaaccgttatcctcatgaattctccggcggacagcgccagcgtgtgggcattgcccgggctctggcagtgaatcctcagttcattgtctgtgatgagccggtatcagctctggatgtttccattcaggcacaggttgtcaatatgtttgagcagcttcaggaggaaatgggccttacctacttatttattgcccacgacctttcgattgtaaagcacatttccaaccggatcggcgttatgtatttaggaaaaatggtagagcttgcggacagctatgagctgaccttccacagcgtgcatccatataccaagagcctgatttccgccattcccatcgcggacccggaaaccagccgcaagtccaagagaatcgtcttggaaggagatgtgccaagcccggtgaatccaccatccggctgccgtttccgcacccgttgtccttatgccgatgagctttgtgcggcccaggaaccggagtggaaagaggtttcttccggtcattatgcagcgtgtcaccatttggacaaagttaattgatttccattgccattttatagcttttatgttatgctaaaaataaatcggcacagtatacagatgacgttttactgtgccgacaaatatattttataggaggaaatttatgaagaaaatgtcacttatactggctgctgtcatggcaaccggtatgattctgtccgcttgcggtgggaataatactgcaggcacaaaagcaggctctgacacaactgcggcagctggtggcgaaactgcagcccctgcgaacggaacttccacggcgcttgatcttgctgtacaggttggtccagatcctgaaaccattgatccggcattaaacaccgctgtagatggtgcaaatattgttgttcatgcgtttgaacctctgatgatcgttgattcggagaacaagatagtgggcggtcaggctgaatcttttgatttatctgatgatagccttacctataccttccatcttcgtgatggcttaaagtggagcgatggcacaccgctgacagccgaagattttgtatattcatggaagagacttgctgatcctaatacgggagctccttatgcaggagatatgctgggttatgtaaaaggctatgaagaggcagctgcaggcaatccagatgctctggctgtttccgctcctgatgaaaagacctttgtggttgaactgtcagttccctgtgtatatttttcaaagctgatcactcatgcatccatggttcctgtacagaaggctgcgattgaggcaaatggtgaccagtggaccttaaagccggagacttatgtaagcaatggtcctttaaagatgattgaatgggtgccaggttcccacattacctttggtaagaatgaaaattactggaatgcaagtaaggttactttaaataccttaaagtttgtcctgatggaagatgccaacgcagcttacagtgcataccaggcaggtgaagtttccttgatcaaaactcttcctacggatgaaattccaaccctgagagataccgaggatttccagattggagccaccatgggcacatattatataagcttccagacccagaaggaaccgtttaacaacccggatgtacgtaaggcactgagtcttgcaattgaccgtgattatgttgctaatacggttatgcagggaatttacgctccgtcaacgaatttcgttggccctggtatctctgatgcagaaagtggttcttcctttgaagaggtgacccgtaagaataacggcggcgatttctttaatatctccgatcatgacgctgatattgcaaaggcaaaagagcttcttgcaaaagcaggatatccggatggtcagggattcccaactattgaatacatgaccaatgaccagctgttccataagccaatagctgagtatttacagagctgctggaaggaagcgctgggagttaatatggacattaagatcgttgaatggtcgacctttacacctacccgtcgtgcaggtgatttccagattgcacgtaacggctggttacttgactatgacgacccctccaatatgctgaacttattaatgtccaccagcggtaataacgatggtaagtacaataacccggaagttgataagaaacttaatgaagcaaactccactcctgatgttgcaaagcactattcattgctgcacgaagcagagaacatgattttagaggattctgctatcgctccgatcgcttattacagccagccatggttacaggatcccaagttaaaaggttcatggtattctccatacggatactggttcttccagtacgctaccatggaataataaagattgtctgaatatgaagagaacacccaggaattgtttcctgggtgttttatttatacccggtctttcttcccggcctgcaaacgggagtggtttatcaaaaaccatattgaaacataatgttatttttaacgaacaaaatgccgttgtaaatatgaatggaacatgctaggattaattcaaatttaagcaaaggagagtctggtaatatgaagaaaaaaccggtgataggagttttgctgggggattattccggaattggaaccgaattggtggtgaaatgcctgcagtcgggggaattaagcaaggatgcagttcctttgattatcgggcatgaatccatattgaaaagggaaatggagcttttacaggtcagcttagattatgaagtgatcagcagtgaaacggatttagcaaaaatggaacaggaaaacctggggagaatcacagtttatgaattgcaggaggcggaactgggcgggattggatatgggaagttgaatcctgtttgcggtcaggcagtttttgttatgatcgcaaaggcggtggagctgtaccaaaagggaatcattgacgggatctgttatgcaccctttaacaaaggagccatgaagctggtcagaccggatgttgaaagtgagcttcagctgtttcaggaagccatggaatacaccggcctgaccggggagatgaatgtggtggaaggcttgtggacttcccgggtgacaagccatattcctctggccaggatcggtcaatatttaagccgcgataaaatagaagaagccattctgctggcagatcagaccatgaaggcggccggcatcgcagcaccgagaattgcagtatgtgccttaaatccccatgccggtgaaaatgggctttgcggcagagaggagattgatatgatccaaccggccattgctgctgccgtagagaaaagggtctgtgtgtcagggccatttccttcggatactatctttatccgggccttccgaggggaatttgacggggtggtgaccttatatcatgatcagggccagattgcactgaaattgaaagattttgcaaatgccgttacggtggccgccggacttccggctcctgttaccactccggctcatggaactgcttttgacatcgccgggcagggggcagcatctgccaatgcttttcttagtgcctatcggatcgttgccgctcaggctgccgggcggacctgccgggagcatgtctgaactcattgtgccaatgtgttttccggctcacaaagtggaatatacattttaactcaagcagttttcagtcactcctaattaaccagttccctctttgagaatttcgaagggggaacattgaatttttttttgaacatcctggagaaattcaggacatcggagtagccgcaggccatggcggcatcaccggttgtcattcccttgaaggcaatgagttcggctgctttgctcagccgcagatccatcagataggcctgggggatttgtccatatacttcttaaacaatgtgctgaaataacttctgtccagattgattcggtcggcgatctgggcgacggttagatcaggattttgataattgacctctataaaattcttggcagctaagatatattctctgcttttgttattttccttgtgcttctttttattgatcagcgctaaaatctcaaaaacctttgcacaaataaaatattctttcaggctttccatgtgctcgcactccataattagacggaatagatagtcgcattccggcgctgagattacatcctcatccagaatggttgaaagatctaagccggacataaaccccacccaacgataatgccagggctgtcctttgtcggcctggtagctggtgacttcaaatgggcgaatcacgaagatctgacctctgtcaaccgaatatgtgccccggtcggtaataaaggttcctttgccggaggaaacgtagtgaagcaggtaatattcacgcatcttaggtccgtacatatagcctggctcacagtattgttctccgcaggtaaggggattaatatccgtcagctgctgattgatgatcatgatgtcttttcggcctgtctcgtgctcgtagttgccgggggcgcagggatcgaagactgtctgttttatggtatccatatattgctgttcagaaatttcataattgttcttcatcgttaaaccaccctttatcatttttataattccaaaattataacatataaaacaaacaaaacacaatatgtattttttaaattatatgttatcatgtatgaaaagatatacaaacaaaaaagatgaaaaacaaaaaaagatgttaatatgcataaaaaataaaatgattttcatctgtattagtcataattatgattttgttttttgaattgtgatatttttatcaataggaaggattggtggaggatttttagaaaaataaaaaagtctgtttgtttggaaatgaaaaaacaacataatgcaaaaaaaggatggtgggattattggcgaaaagagcagcgacagatgtaactttaaaaaaacgtccgttttggcaaaatataaaaatagtgccttacctttacattttgcccaatatgattttattcatggcgtttatgatcattccccttattatgaccgggtattacagtctggtcaagtggaaggggcttggaaatccgaagtttgtaggtttggataattttaagaaaatattgactgatcagatatttttaacctcattacaaaatacggttaaattctccgtcataacggttccgctgttgatgactctggctctgggattagcggtgctgttaaacagaaagatggcggtccggggattttttcgaagtgcattgtatattccgtctattatatccatggtagcggcaggtatgatttttatatggatttttaatccgcagctgggactgattaactatctgttggaatcagcagggcttaccaggatcgactggctcaatgacccgcgttttgcgatgatcatgattgtggcaggtacgttgtggagcagggtcggatacaatatggtgatctatctggccgggcttcagggaatatcctcggattattttgaggcggccaccattgacggtgcctctggctggcagaagttcttgtacatcacatttcccctgcttcaatccactcacgtatttatactgattacctgtattatttattcgtttaagacctttgatctgatttatatcatgaccaagggaggccccctcaacgctaccaaaaccctggtagtgtatatctatgagacggcattccttaaaaataattatgggccggcatcggcgtcaggagtaatcttgtttgtgattttgttcctgtttacattgttccgctataaattccaaaaggaggaaagctgatggtcaagaaaagaataactgccctggatgtgttcacctatatcgcaattatctgcatcaccattatttttctctttccgttttattggatgtttgtgacggcggttaagccggtggaggaaatatttgcctatccgcccaccctgtggcccagccggtttgagtttggtaattttgctaaatcctttcgggaaaacaactttctggtgtattttaagaatagtaccattgtaactgtctcagccaccacgataactgtttttattaaccttctggcaggatttgcattcgctaaatataagtttaagggtaaggaactgtgtttcctgatcatcttaagcacactgatgattccggtgcaggtgaccatgatccctaactttataatcctgtcaaaatttaagatggtcaatacttatgcgggactgattctgccgccatgtgcggaagcttttggactgttcttgtcaagacagtttatgtcagaaattccggatgaactgattgaagcagccagaatagacggcgcaaccgagtttcagatttttacaaaggtcattttacccaacacaaagtctttgatcagtgttctggtgatctttacagttatgtggcgctggaatgattttcaatggcctttgatcgtattgtcaaaaagcagcatgtatacggttcagatagggctgcaattactcaatggggcacagtttgtcaattggaacatgctgatgagtgccgcattgatcactacgataccggtgctgattgtgtttttgatatttcagaagcaatttgtacagggtatcgcatcatcgggtatcaagggatagtgaaatataatcttaataaacaggaggagcagaatgaaatcaaaaacaggaaagatgttagcagcagttcttatgatgtcagccattgtgttgtcatcagggtgttcgggaaaaagcacaccgccgccggccgcagccggccagaccgaagcaaatacccaggagacaggagcaccggctcaggccgaagcagcaaatgaagaagaattaaaagcagaagatggtgcggtgatcaagttcgcttattgggaaggctctccatcggatacagcagcctggaaagcagttcttgaccggttccggaaagatcatccggagatagagctggttgcggaagcttatccatccaaaaccttccgggatcagctggataccatgatcgccggcaatgaatggccggatgtaatgcggtatacctatcagagattaggtaaatttaaagaagcggatgtgatgcttgatctgaccgggaaaatttcacaagaaactttagatgatttgattccggcttataaagaagctcttacttataacggaaagctggttggtttgccccatcataccgataccattgcgatcttctacaataagaaaatgtttgaggaagcgggaatccggattccaaagaataccactgatggctggagtttggaagaattgactgagatttccagaaagctgaaagcagaatatgatctggatacggcattttcgggaatctgggagaatggtaatggttaccggttccttcccctcctttacatgaacggcggtaaaatcttaagtgatgacggaactgaaattgctgtcaattctccggagactctggaggtcttaaccatgctgggcgattggacgaaagaaggactgatgcctaaggcgagctttctgcaggatgcccagaccaacatgatgttctcggcacaaaaaactgcattcgtatttgccggaagctggcatactacctttatggatgaaaacttcaaagacggctgggctgttacatacatgccgcaggtcaatgggaaaacaacttctgatcttggcggaaacggattatttgcttataaagaaaccaaataccccaatgcctgtgccatctttatcgactatatcgccagaaaagacaatatgaagcttttctgcgaagaaggcaattttattcctgtttcccagagtctgattgcagaagggcttgaatttaagaattttcctgaggaaatgaaggttttcttagagatagcagcaaccgtagatcctaagatggctcaggatgagacctccagcaggttccagcaattaaacgtaatctggtgcgagcagaccgaagcgctgattgtaaacggttccgtaagccctgaagataccatgaaaaacctggaagaaaaaatgcaagaggctttagacgaataaggcgaagggagcacaaagcaatgaaaatcacatttttgggcgcaggcagttctgtgtttgtaagaaacgtcctgggtgattgcattttaacacctgaaataaacgatgccacatttgcactgtatgatattgaccaaagcagagtggaagagagttaccggatgatggtaaatatcaatgccaattcaaacaacagccgtgctgtatttaaaaaatacgtcggtctggatgaattgccagaggctttaaaagatgccgactttgtcatcaatgccattcaggtcggcggatatgatccttgcaccatctgggattttgagatacctaaaaaatatggtctgcgccaaaccataggagataccatgggggtcgcaggtgtattcagggctctcagaacaatacctgtcatggagatatttgcagagcagatgaaccgctgctgccccaatgctcagcttttgaattacaccaatccaatgggaatcctgactggctatatgctgcggcatacggatgttaaaacagtagggctgtgccatagtgttcaaaaatgtacaagagaattgctgacagggctcggtctgaaagatgacacagatattcagtcaaaaattgccggtattaaccatatggcctggctgctggagatatcaaagaacggaaaggatctgtatcctgatctaaaaaagctgtaccgggagaagggctgtgtggatacggataaggtgcgatttgagatcatggataaattcggctactatgtaacggaatccagcgagcataatgcggagtatatgccctatttcatcaaggcagcctatcctgaattgattgattattacaatgttcccctggatgagtatccacggaggtgtgtgagaaatatcaaacgttgggaagacatcaaggcggagctgactgagaattccagattgacccacgaaaagtccattgaatacgcagcctatatcatacagtcatttgcaaccaatcagccatataagtttggaggcaatgtaatcaataatggaatgatctccaatcttcccatggaggcttgtgtagaaattccctgcatttctgattccaccggtatcaccccgacctatatcggagcattgccggagcagtgtgcggctctcaaccggaccaacttaaatgtacagctgctgaccatcgaggcagccagaacccggagtaaagaagcggtctatcatgccgctatgctggaccctcacacagcggcagagctgcctcttgataagattatcaaactttgtgacgagctgtttgatgcacataaggactggatgccggtttatcattaaatatgaagtgcaaggcaaatatcatctgaatgttaagagaacatccgggaattattcccgggtgttttgtctttggccggcctttgttccctgcatgcaaacttcctctttccaaccatccgaaagtatgctataatctcctaagacaatacaaaagtacaggagagttaaaggctatgaatccaagacgagtattattaaaactcagtggcgaagctcttgccggtgacaataagacaggctttgacgaagctactgttaaggaagttgcacggcaggttaaaatatccgtagaggcaggtgtccaagtgggcgttgtcattggcggaggtaacttctggagaggcagaaccagcgatgccattgaccgcccaaaagcggatcagatcggcatgcttgcaaccataatgaactgcatttatgtttccgagatattccgcaatgccgggatgaacactcatattctgactccctttgaatgcggttccatgacagagcttttttccaaggacagggctaacgggtattttgaccagggtgaggtggtattttttgcaggaggaacaggacatccttatttttcaacggatacgggcgttgcgcttcgggctattgagatgaatgcgggctgcattctgctggcaaaatccattgacggagtttatgacagcgatcccaagataaatcccgatgctattaaatacgatacgatttccattcaggaggtcattgataaacagcttggtgtcattgatttaacagcttccatcatgtgcatggaaaataaaatgccccttgcggtattcagtttaaatgaaaaagatggcattgccaacgcaatgcaaggaaaaataaacggtaccatagtgaccgcataaccaggaggacgatatgcaggagagtttacaggtttacgaagacaagatgaacaagacattaaaggcgctggagaacgagtttatgacgatccgcgcaggacgtgccaatccacatgtactggataaaataagagtggattattatggaacccccactcctatccagcaggtaggcaatgtttccattccggaagcccgtatgatcgtaattcagccgtgggagagaaacttgctgaaggcaattgaaaaggcaattctcacttccgagctggggatcaatccaaccaatgacggcaatgtgatccgccttgtatttccggagcttacagaggaacgcagaaaagaactggtaaaggatgttaagaaaaagggagaggctgctaagatcgccatccgcaacatccgccgtgatgccaatgacgccttcaaaaaacagttaaaggcagaagaaatttcagaggatgagcaggcagaggctgaagacaagatccagaaactgacagacaagatggttgacaaagtagaaaaagcagttgaggaaaagtcaaaagatcttcttactgtataaaaatcttgaacaggggggcaggcattttgcctgtcctgttttgtgtttttaaaggagcggcattgtatggataaaatgaacgagaatatggtgattcccgagcatgtggccattatattggatggcaatggcagatgggcaaaaaaacggggacttccaaggagcatgggccataaggaaggctgcgtagtcgtggagaagacggtagaggatgcagccaggctgggaatcaaatatctgaccgtttatggtttttcgacagaaaactggaagcgcacttccgatgaagtgggcgccttgatgcagctgttccgttattatatggtcaggcttttaaagattgccaaagccaataacgtgcgtgtgaagatgatcggggaccggaaccggtttgatcaggatattatagagggatcggcagactggtggagcagacaaaggacaataccggtttaacctttgttattgcggtcaactacggaggacgtgatgagatcatacgggcgaccaggaatatcatgaaggattcggccggggtaagcttttgcctgaggatatgaccgaagaggtttttgcctcttatttggatacggagggaattccggatccggaccttcttatacgcaccagcggtgagttgcggctttccaactatctgctgtggcagctggcctatacggagctttatgttacggactgctattggcctgattttaatatggatgaaatgaaaaaggcaattgcagcgtacaatagtagggaacgaagatttgggggagtgaagtgattcggagggaggaagcgcgatgtttacaaccagactgataagcggagtcattctcgttttaattgctctttttacagttggaagcggggaattctgctttttgttacaaccatttccatttccatgattggtttgtttgagttgtatcgtgtgatgaagatacagaaaaacccattggggtatatggggtatataacggccctgtcctattatgggctgctttggtttcgtggagagcagtttatgatgctcatgtccattgcatttttgatgatcctcatgagtatttatgtatttacctttccaagatatcagatggaagaggtgacagtggccttttttggggtattctatgtagctgtcatgctgtcctatctttatcaggtccgcaccatggcagatggaaaatacctggtgtggctggtgtttttaagctcatgggggtgtgatacctgtgcttattgtgtgggaatgcttataggaaaacacaggctggctcctgtactcagtcccaaaaaatccatagaaggtgcagtgggcggagtggctggcgcagcgcttttaggattcctttacgcatcagtttttggaggggccatgctggagatacgcgatccacaggttgcctgcggactggcctgcgccattggggcggtgatctcccagatcggagatctggctgcatctgcaatcaagcgcaaccatcaggtaaaggattatggaaaactgattccgggtcacggggaattttggaccgctttgacagcatgctctttacggctcctgccatttattttgcggtgacatttttgcgttaaaaggatatttttggaaaagaaaaggagtaagcagcataagatgaggaaaatagcaatcctgggttcaacaggatccattggtaaacaaactctggaggtagctgaaaatcaaagggacatagaagtaactgccctggctgcaggcagcaatattagcctgctggaggagcagatcagaaagtttcaaccaaaagttgtatgtgtgtggagggaagataaggccagggagctggcggtttcggtaaaggatttaccggtccgcattgtttccggaatggaagggctaatggaagcggcctcggaaaccgatgcggaaatcgtggtcactgccattgttggaatgataggaatacgtccgaccattgctgccattgaagctggaaaagacattgcccttgccaacaaggaaacccttgtgactgccggacatatcattatgcccctggcaaaggaacggggagtgaagatccttcccgtggacagtgaacacagcgccatctttcagtgcttaaacggagaagataaaaaggcagtacataagattcttttaacggcttccggcggccctttccggggaaagaccagaaaagacctggaaactgtgcaggtggaagatgccttaaaacatcctaactggactatgggaaggaaaattaccattgattcttccaccatggtcaacaagggccttgaagtgatggaggccaagtggctttttggtgtggaaatggaccagattcaggtggtggtccagcctaagagcgtgatccattccatggtggagtttgaagacggagccgtcatggcccagcttggaacgccggatatgaagcttccgatccagtatgcactttactatccggagaggagattccttcccggcgaacgtttggatttctggaccattggtcaaattacttttgaaaaaccagatatggtaaattttcccggattaagattggcttatcttgccggcagagaaggcggaactcttccaacagttttcaatgctgccaatgaacgggcagttgccaaatttttagatagagaaatttcatatccagctataactgatatgatagagggggctatgaacgggcatactgtaaaggagaatccgacagtagaggaaattcttgaagcagaagctgcagcttatgaatatatagaaagcaggtggtaaattgtccagtgttatcgtagcggttctggtttttggactgatcgtattaattcatgaattagggcattttttattcgcaaaaatgaacgggattgcggtggttgaattttcaatcggcatggggccaagactgatccgatttaaaaagggagaaacaacttattccattaaggtgctgcccttaggcggttcctgtatgatgctgggagaagacgaggaaaacccggatgaacgggccttccagaacaaatccattcccgcccggatgtcggtcattgcggcaggtcccatatttaattttattttagcctttatcctggcagttctcctggtgggaatgaacggatacgatactacctatataaaggaagtaacggaaaactctcctgcctatgacgcgggaatccgtcccggagataagcttcttaagatcaatggggagaatgtgtccatgtaccgggattacattctttataagctgttaagaccagaggagaagatgagcatggtggaattttccagggttgacccagccaccggcagtgcgaaagtccaatctacttccgttactcctcagtattccaaggaaagcggaaaatatttaatcggtattaccattgctcctgaaaataaaaaggcagcttcttttggtgaactggttaaatacggatatatggaaatggaatacgatgtgaagctgactgtaaaaagtcttggcatgctctttaccggtaaggcaagcgtcaatgatttaagcggtcctgtaggcattgtggttatgatcgatgattctgttaaggcaggacttacggtcagcatcgtagctgcgcttatgaatgtgatcagcatgtgtattctcttaagtgcaaaccttggcgttatgaatcttcttccaattccggcccttgacggagggcggcttttgtttctgatcattgaagcgatcagaggcaagcgcatggatccggagaaggaaggcctggtaaatatgatcagcatggcggctctcatggctcttatgatttttgtggtgtttaacgatatcagcaggtttacgtaaccaaaccgtatttatgcgggcaattagccggaccggcatgcccgcatgtatacatggcgctgccgtaataaccggatggaactcgtttgacggggtgcttccggttttaaggcatgcacaggatttgcagtatggaaaggcgtgcacagaatggaggaaccaatgagcagagaacgaacaagagtaatccggatcggagaccgggtgatcggcggaggaaatccggtcctgatccagtccatgtgcaatacaaaaacacaggatgtggaagcaaccgtgagtcagatcaaagctctgacagaggccggctgcgatatcatccgggttgctgtgccggatatggaggctgctgaagccttaaaacagataaaaaagcagatttctatccctctggtagctgatattcactttgattaccggctggccattgcctccatagaatcaggagcagataagatccggatcaatcccgggaatatcggttcagccgaccgggtccgggcagtggtggaaaaggccagagaatatgatatccccatccgggtgggtgtaaacagcggctcccttgagaagaatctcattgaaaagtatggaggggttactgcggaaggaattgtggaaagtgctttacataaggttcgtatgattgaagaactggggtatgaaaatctcgttatcagcattaaatcttctgatgtgctcatgtgcgtcaaagctcatgagctgattgcgggacagtcggattatccccttcatgttggaataacagaggcaggtacttatgtttccgggacagtaaaatcctccgttggtctgggaatcattctttacgaaggaatcggagatactatccgcgtttccctgaccggagatccggtagaagaagtaaagaccgcaaaactgattttaaaggcactgggcttaagaaaaggcggtgttgaggtggtatcctgcccgacctgcggaaggaccaggatcgatcttatctccctggcaaatcaggtggaagaaatggtttcaggctttgaccatctggacattaaggtggctgtcatgggctgcgtggtaaacgggccgggagaggccagagaagcggatcttggaattgcgggaggaatcggtgagggtcttttgatgaaaaagggagagatcatccgcaaggttccggaagatcagctcctgggtgccctgaaggaagagctaatgaaaatgcaataggtgatggaatggcaaaaagatttttggaagtttttccaggcttacatatcacagatgaattacgggagcttttaaatctggtagaagtggagaaagtcactttaggcagggatagaggctctattcgtatttacctgctgagccaaagactgatacataaacaaaatatttacgctctggaaaagggaatcaaggaccagctctttccctccaagcggcttactataaagatcatagagcgattccgtttgtcaggccagtatactcctcaaaagcttttaaaggcctaccgggagagcttattaacggagcttaaaaattacagcattattgagtacaacatgttccgcaaagcggaataccggttcccggaaccggatcttcttaaaatgacggtagaggataccattgttacccatgaaaaggccggtgacttaaagcggatcctggagaagatttttcatgaacgatgcggtatgccggtggaggtccagtacgaatatgtggctccaaaggagaacgagctggcaaagcaaaaggagctgcagatgcagcgggaggtggaggagatcgtaagccggacttccctggcagtcagaaagggaggagaccaggaggagtacggcgccggaagcagcgggggaaatgcaggaccttccatgctggaaggtgcttccttagatgccctgactgcaggatatgtggcttccgttgcttctgaccaggctccgaaagcccctgcccctgggctgcgcatgggcggaaaaaaggaaggttttaagggcggggattcggattccgggaaaaaggaatggaaggattataaaaaggggggcggttcctatggacgccgctcggataatcctgacgtattatacggccgtgattttgatggggaaaccattgaaatagaaaaaatcgacggtgaaatcggcgaagtggtcatccggggcaagatcctaaccgtggacagcagagagctgagaagccagaagaccatcatgatctttgatgtgacggattttacggatacgatcactgtaaagatgtttgccagagaagagcagattgaggatttaaaggcggctgtggtacagggaacttttatacgcattaagggagttaccaccattgataaattcgacggagaactgacccttgggtcagtggtgggaattaagaaatcagaggactttaccgggaagcgggtggacaacagccttgagaaacgggtggagctccattgccatacgaaaatgagcgatatggatggggtttctgaggtcaaggacattgtgaaacgggcaaaaaaatgggggatgcctgctattgccataacagatcacggctgtgtccagtcatttcctgatgccaatcatgccctggacaagggggatacctttaaactgatttatggagtggaagggtatctggtggatgatttaaaacagctggtggagaattccaaaaaccagggtttttcggattcctatgtggtgtttgatattgagacaactggctttagttcttccaggaaccggatcattgagatcggagcggtaaaggtgaaaaatggagtgataacagataaattcagcacctttgtaaatccggatgtacccattccctttgagatcgagcagcttacgggcatcaatgacaatatggtcttgccttatcccaaaatcgatgaaatcctgcctcagtttctggacttttgcgaagattctgtcctggtagcccataatgcctcctttgacgtaagctttatcgcctataatgcggggcggcttaacctgccctttcagcccacagtcattgatactgtggcacttgcaaggcttcttcttccaaaccttaaccgctttaagctggatacggttgcaaaggcgctgagcatttcgctggaaaaccatcacagagcggttgatgatgcgggctgtacggctgagatatttgtaaaatttgtgaaaatgctccgggaacggggggtggaaactcttgatcagctgaacgggttaagcgccatgtctgcggatatgattaaaaagcttccgacctatcatgtgatcatactggctgccaacgatgtgggaagggtgaatctttaccgcctgatctcttgttcccatattgattattatgccagaaggcccaggattcccaaaagcgtgctgaaccagaaccgggaagggctgatcgtaggctctgcctgtgaagccggcgagctttaccaggccttgcttcggggtgtttctgatgcagaggttgcaaagctggtgaacttttatgattatctggaaatacagcctttgggaaacaacgcgttcatgctcagggatgaaaaaagtacggtaaagtcagagcaggatttgatcgacatcaacaaaaggatcgtgacccttggagagcagtttggaaaaccggtctgcgccacatgtgacgttcattttctggatcctgaggatgaggtttacagaaggatcattatgacaggccagggctttaaggattctgacgatcaggcgcctttgtatttacggaccacagaggaaatgttaaaggaatttgaatacttaggccccaataaggcagaagaagtggtaataaaaaatacaagaaaaattgccgacatgtgtgaaaagatctctccggtacgcccggataagtgtgcgcctgtcattgaaaactctgacgaggatttaagaaagatctgttatgacagagcccatgccatctatggagaaaaccttccgacgattgttacggagcggttggaaagggagcttcattccatcatttccaacgggtttgcggttatgtatatcatcgcccagaagctggtttggaaatccaatgaagatgggtatctggtaggttcacgaggatctgtaggttcttcttttgtggcttatctctcaggtattacggaggtaaactccttaagccctcattattattgcgcctcctgtcattattatgattttgattcagaagaagtaaaaaagttttccggtatggcgggatgtgatatgccggataaggtttgtccggtgtgcggacgtcccctggcaaaggacggatttgacattccttttgaaaccttcctgggctttaagggagataaggaacctgatattgacttaaacttctccggtgagtatcaaagtaaagcccatgactacacagaggtcattttcggcaagggccagaccttccgtgcaggaaccattggtactctggcggataaaacagcttttggttatgtgaaaaattattacgaagagcatggagtgagaaagcgtaattgtgaaatcggcaggatcgtgcagggatgtgtgggggtcagaaggactaccggacagcatccgggcggaattatcgtgcttcctcacggggaggagatctattcctttactccggttcagcggcctgcaaacgatatgactaccatgacggtgaccacgcattttgactaccactccattgaccataacttgttaaagcttgatattctggggcacgatgatcctaccatgatccgtatgcttcaggatctaatcggatttgacccggtaaaggatattcccttggacagcaaagaggtcatgtccctgtttcaggacacctcagccttagggatcacgcctgaggatattggaggatgtaagcttggagcgttgggcgttccggagtttggtacggattttgccatgcagatgttgattgatacacagcccaagtatttttctgacttagtgcgcattgccggccttgcccacggtacggatgtgtggctgggaaatgcccagaccctgatccaggaggggacggcgaccattcagacggcgatctgtacccgtgacgatatcatgatctatttgatatcaatgggtattgaagaaggcttatccttctccatcatggagagcgtccgaaagggaaaggggttaaaagaggagtgggagaaggaaatgattgcccacagagttcctgactggtatatctggtcctgtaagaagatcaagtacatgttccctaaggcccatgctgctgcctatgttatgatggcctggcgaattgcctattgcaaggtgttttatcctctggcttattatgcctcctttttcagtatcagggccaatggcttcagctatgagctgatgtgccaggggcgggataagctggaatattatctggctgactataagaagcggatggatactctttccaaaaaggaacaggacaccttaagggatatgaggatcgtacaggagatgtacgccagggggtacgactttatgcccgttgacatttaccgggcaaaggcaaggcatttccagatcattgacggcaagctgatgccatccttaagcagcattgacggactgggagaaaaggcggccgatgccgtcgtggatgcggtaaaggatggagccttcctgtccagagaagatttcagaaacagaacaaaggtcagcaagaccgtatgtgatctgatgggggatttaggccttctttttgagctgccggaatccaatcagctgtccttgtttgacctgggctgatgagggaaaatgagagcctcagatgcccgggagtttctctgacaagatggtaactgaattttatgggaatttttccagaattttaaaataataaaaaaattttgaaaataaggttgacatacgctgggatttgtattatactacctaacgtaatcgaggcgtggctcagtttggtagagcgctgcgttcgggacgcagaggtcgcaagttcgaatcttgtcgcctcgattctgcaacaactatatttgtttcatggcctattggtcaagcggtcaagacgccgccctctcacggcggaaacccgagttcgattctcggataggtcataataaaaaccttcagggcagcctgggggtttttgcgttaagcagatcatttttaaaatatgggcaagaggatatccaattttttatcagatggagaaaaagagatgcttgccttttacggaaaaaccgttgcttttacatatagggaaacaacattgccacttataaattatgtacgggatttatgagtattgcgaggtgaaaatggatcatatttcgctggatgagataaaagataaactggatttcttttataaaatgtatgatgtggtacgcctggtggatccggtccacaaaagggtgctggactaccggcagtcatccctggctgtcacacaggatgtatgctatcattattgggggaacaacaggatttgcgataactgtatttctgtaagagcttatcaggaaaacagaagctttgtgaagatggaaagaagcggggatgaagttcttcttgtgacgtcaattcccattgaaaatgccgccagcccggcagtgttggagctgttaaaaaatgccacggatacaatgtttatcggaaccggtgattataatgaaggagaaatcttttcccgctttatcaaggagcttaatgatgcggctgtgagagatcctctcacctctatttataacaggcgctttgtggatgagcgtcttcctgttgacattattgatgcttccctcaagcatgcaccgctgtctgtatgttttattgaccttgataatttcaaatccattaatgacctttatgggcatgatgcgggagattcggccattaaggcggccggtgaagtcatttcccggaatatttgccttgagggcgtgtgggccgcaaggtatgggggagatgaattccttctttgcctgagtggaactgatgaagggcaggccagggaggttgtggagcgtataaaaagagatattgaaataacgcccatgggagagatccctctctccatttcttatggaatagaaaccatgaaggatgttcccgtgactgcagaggaactgattcacagggcagatgaaaaaatgtacaaggctaaaaaggaaaaaagttcggatgcatgatgggaaggctgatttataatgctgcttcatgatcccttgctgatataaggatcacatatgtgatatacgaactttgagaccggtaaaagaacgatctggaaaaaagaggaaagagcaggagataaaagagctggttataaagaatttggaatgggcatcctacataaggcttggaatgtgtcaattcagcagtcaaaacattctaaaaacgaaagaaatcctgttgatttattcatgtgattggaattatactttatataataaaaaatttaaataacggaggtaaaaacatgttcaatcctatgattgctgcattgaaagagcagaagagaaaaatcgtatttacagaaggcactgaccccagaatcttagaagcagcaagccgcctttacaaagaaggcatcctcacccccattcttctggggaaccctgatgaaatcgaagcagcttccaaggaatgtggctggtccattcatggtatcgagaaaatagatccccttagctatggggaaattgaagaaatggtaaccaaaatggtagagctgagaaaaggaaagatggatgaagcggcctgccgcgctgcgcttgcaaaatccaattactttggcaccatgctggttaaaatagggaaagcggactgcctgctgggcggagccacctattccactgctgatacagtaaggcctgccttgcagctgatcaaaaccaagcctggcagcaaaattgtttccagctgtttcattctctatcgtgaggcagaagagggaaatgaaatgtatgccatgggtgactgtgccattaatgttaaccctgatgaaaacgagctggttgaaattgtattggaaacggccagaacagcaaggaccttttccattgatccgaaggttgcactgctgtcttacagcactctcggttccggcaaaggggaatctgttgataaggtgcacaatgcagctgagaaattaaaggcaatggatctggacttccctgtggatggagaactgcaatttgacgcagcattctctcctgtagtggctaagacaaaagctcctggttctttagtagcaggacatgccaatacgtttgttttccctaacattgatgcaggcaacattgggtataagattgcacagagattgggggctttgaggcatttggtcctattttgcaggggctgaacgctcctatcaatgacctttcaagaggctgtaatgcagatgaagtctataagatgtcgattataacggcttctctgatataaaacttaaaatttccgggattgagtagaaagaatacaaatttgctgatttgtgttctttcttttttatgccgataatatggaagattttggaaccagctgagctggattttaccgagaattgagatcaaaaggactagatttaatagcttaatataaataagaaaaaaccccgcaaacacgaggttttacataagctcccgggggactcgaacccccgacccacgcattacgaatgcgttgcgctaccaactgcgctacggaagcaatccggtttttcaatataacatttgaacctttgatagtataccagcaaaggcataaaaaatcaaccctttcatgaaaaaaaacttaaattacgtaatgattgccaaaccttccataaaaagctataattagtgaaaggttctaatagagaaagcttatttctaaggggttaattttctatgcaaaagatggaagacgtaaaaattaaaaaaggaggaatgttggttcctgtgttcctttgtttgatttttgttacatgctgttttacgtttttaacatatatggtaaaaaaaaatgagcaaaaggatgttgcatatttttacagtgcggcaaaacagaatcaggtgacccttaagaatcaaatggagggggattttcatgctcttaaaggcctggctgtatgccttgaagccttggatccggataataaggaacagatggaccggatcataaatgagattaacgatggaagccggtttatgaaggtgggctttgcagacggctctggttggatggaatcggaccattatgatgattattataaagttcctgtaaggaacagagaggatcagcctgtaggtcttctttatgccacaaattccggagacatggtgcgcagcatgattgatgccgctattctggctggagaaggcttttcggaaattcttgaccagcatggaagagtgatcgcaggaagcgccggagtaagggagcaggagaaggttcaggaagcaataaaaaagggaagtcagatcccttttaccatggtctctcaggacaaccggcgtcaaacggctgttttgattcctctgggaatcaatgactggtatgtattaagcgtttttcctcaatacagcatgaggaccaggcacatagaggcgggaatcggaacgttgattttgctgtcctcggtactgttcctttattttttctgccgtcagtgcagaatcatcaatcaaaatcaggaggcccttctggaactggcctatagggacagcctgaccgggtgcagaaatttttcttcctttaaaagagaagcggagcgggcaattcaggaagatgatatttcttcttatgcagtgtggtattgcgatataaagaaatttaaatttatcaatgatattttaggatatgaggaaggggatagaatcctcacttccattgccaatctgtttcgggattatggggaagaggaatcgctattttgcagagtatcagccgataattttgcaggacttcataaatacaaatccagggaggatatgcgcagctggtttaataagctggttgagttttttcaaagcagggagctgccttccagtaaaagaattaccatggagctgtgcatgggcgtttattgtctggaagaagaagatcgggaattgtccgttgaacggatcgtaaaccgggcgaatattgctcagaagcatgtaaaaagccagccaggaaatcagttcggcttttataataaggaaatacgcaataaagtggtatatgaatccgagttggaatccgagattgacagggcaatcaggaaccaggaatttaaggcatttatccagcccaaggtatccattcagaagggaaaccggattgtaggggagaagttttggtgagatgggagaacccacgtaaaggcaccataccgccagggatgttcatacctcttatggagcgtgacggaaagatcgtgaagcttgacagatatatgtttgaagtcgcctgtcaatggctttgcaactatttaaagtccggcagggaaccggtgaacctggctgtcaatgtttccaagatcggaatgctgcgggaagattttgtggatttttacgggagagtgaaagaaaaataccagatacctgacggccttctggaactggagtttacggaaacggtcatgctgaatgatgacactgttttcagcggtttagtgagccggctgcataaaaaggggtttgtatgttctttggatgatttcggttcaggatactcttccctgaatctgttaaagaatcttcccattgacgtactaaagctggatattatgtttttcaggaaaagcacggatataaaacgggaaaggatcgtcatatccaatatcataaacatggcaaaggaacttcagataagaaccatcgcagaaggggtggagtacgtagaaaccgtggattttttaacatcagctggctgcgatgtgatccagggatatgtgttcgccaagccaatgccggttgaagcctttgatgagatgctattaatgaaaaaaggagaagccctgataccccaggatgtcagggcataggtgacagtaatggaaaaatgggaaaagatccgaaagcacatttatgtcagcggtcgggttcagggagtgggattccgcttccgtgcccagcagcttgccaggggctttggcctaacgggctgggtaaagaacttagatgacggccgggtggaaatggaactgcagggaacagaggtggaaatggaccgcctgtttgaacgtttgaggcaggatcgttacatcagaattgacggtttccagacagaacggatatctccggtagaagaaaatggattccaggtcaggtattaagcgcatatattgaaactgagactcccagagctatatactgggagtttttgctttattaaagagctttatttcttcacgatagaatgttaacgctatgattgcagctactccgtcagcaatcggaccggcatataatatcccatcaattcctaaccatagtgggagcagtaagacaagcggcagaaagagaaatacttgtctgcttaaagacatcactgtaccccgcattgcccgtccgatggaggaaaagaagctggatgttaaaatttgtattccgtttatgaatgaaaaaaagaggaagattctaaaataacgaatgccaaattgatagtacaattcattgccttgtccgaatatccgaataatctgtccgggaaacagttgaaagcacagaaatgccgtagtaccaatcgcaacgatgattgttgcagcgcatttatatgcttcttttacgcgcttataatttcctgttccataattaaatcccataattggctggcagctttgtgagatgccgaacataacagaggtaaaaatagagcttacttttgatacgataccaacacaagccagaggaatatctctgccataaacagaaaattctccataatgtccaagagagttgtttaaaacaacctggacaaccgttacggctaactggttcatgcatgctgccatgcccagggaagcaatatctttaactgtagataatcgaagtataaaatgagcctttgtcagtttcagtgaacggaattttctgaaatagaaaagtatgatagcagaagaaactatttgtccggtgattgttgcaagagcggcgccctgaattcccatatcaaaagtaaagataaacagcggatctaaaaccgtatttaagatagcaccgaataaaatgctgaacatggcatatcgggggctgccgtcagctctgatctgttggcttaaagcggaactgacgacagcgaaaggaatacctattgctgtaatgcctgtgtattgctttgaataagttaaaacgtcacctctcgcaccgaaaacaatcataagcgggtgcaggaatatcagtacaataacggcaagaaatactcccgaaataactgccagaatgatgctgttgccaatataacggccggctttttctttatcattctgccctagtttaaggctgaactgtgatgcgcctccaattccaatcatcatggataaagctgtcattatgataacaagcggaaaggcgacatttgttgcggcatttcccagcggtccgatgctttggcctatgaaaatctggtctacaatattgtataaagagtttacaagtccgctgattgttgcaggtattgcgaattttcgaatcagcttccatatgctgtcgctttctaaagggttcttttgtatgctgcatgatatgtcactcatcttgcgggtcctcctctgatgtcaataatactgcgcgtaaattgtcctgtaatctttccaaactgcatttcagataagataattcctgctcagaaaaatttttttcaagagactgatgaagtctggtctgcagatgtcttatatgcttaatcacttcgtccgctttttctgttgcatatattttttttgaacgatgatcagatgtatcagattcgatacgtatatatccttcttcatatagacgctttaatccttttgagattgtgcttttctcagcataaaaagtgtccgtcagggtttgtgagtgaatgcctggattggtataaatatattccaacaaaaattgctgtgcccagcctattttatatttttgaaggcctctgtcataataaattcttattcccttatttatgccgggaatatattgatcgatatttttcattttttttcctcctgaaaagtattataatgcaaaatagtttccatagcaactattttttgaaataggaaatttatgcccgatccgaaaaattatttatgtattatatattgagagtttggctcataaaaggagtggccggcaagatcgggtggaatcctgccggctgtatgaaaaaaaggttttatttaaaaatgtcttacaaggcagaatctgggattctcgttctctggaccatacccgattcgtaattgggaggagcataaaaagatgagattttaagcggctcattgccaatattaatgatgttatgccatgtacctgcgggtacgaatactgcataatttgtaaatgccagatattgtccgtacattgagaacttatctgcccccagctgaaccaggcctaaaccttcctctattcgtaagatctggtcgtgatcagggtggacttccattccaatgatctcacccacaggaatgttcatcagaatcacctgtaaataagttcctgtccataaagccgagcggaaattatcgttttgctgtgccgctttgttaagatcaataacaaaggggttcggtccataatctgatggaaaggttggcatattaccagcatcaggatttgagttttcggaaataaacatgcggttagtcaccatttatacattttattctaatatatgtgtcataaaaaacactgttataaaaaatcgggaatttcagaaaaaaggagatgtagaattgaatttcctgctgcaggaagtgcaaaaggtatttattaggctggctaatgctgcagattgtgaccaagacaaaggatagctggcagttttttgcaatatggtaatataaagcaggaatataatacgcccaatagccggataaaagtttagactgtgccatgaacatgacatactgttgtcttaattcatgtgatatgcttgtttcaaatgataaacaggaggtaaatgggatgaatgaagaaatgattgctagagccggagaaatgattgctaaaaagaccggtggaggaaatgaggggtattgcgtattggcattgatagacaaagatggatatccaactgcctccaccatatccgcatcaaaggcagacggtatcaactggattacattctgcaccgggcttgaaagcaataagtctgatcgcattagaaaatgcaacttggcaagtgtttgttttaatgcaatagaccacaatatcacactggtgggtacaatagagatattaacggacccggatgtaaagaaagagatgtggtacgagggtcttgaagataatttcaccggaccggaagacccagactactgcgttttgcgttttaagacaagtcgctacaatctgtttgttgattggaaagaggcaaaaggttctttataaatgagtgtataaccaactatcaatatacggtagttggttttttattgccggaagaggcccagccggagcgtgttcccgaaatattcaatgtgagacaggaccgtgtcggcgtttaagcatgggagtttgtgtctggacccggggctggggagatttgtcggtgaaaagaaagtggagccctaaaacggaatatataaagagcccgactatatttagtcggaccctaccaaagattacatgaatgtggctaaacattcatctaaattataacacataaaaatgtatatttcaatcattatgatgaatttttattcatattttttaaattaaagaaggaaagcagcggaaatagatgaagacattttgattaaatattccgaaacactggcttaaccggagctcatgggacagcagcgttcactggatttccagcagcagaatcaaagagggggccgggcctgggaaaaacaaaaaaacctggcatttacaaggaattcttgcatttaccagggtaaaataaaaagcagataacgggaatcgaacccgcctcctcagcttgggaagctgatgttctttgaaactggttttatcatggtctatcatgctttatctcatagaaaactggtggttttctttttatcatgttttatcagtatttatagaaagtggtgtcaaagtggtgtcaaaagggaataaatattccttatgtcacgaggactgaaattaagtttttcgtggaatgctagtgaccctaacaccagatcaggacggggtcttgaggcagtcaggtgtaacagtttggtggctgattcgtccggtttatacttttctcatattttatccgggtaaaagacctcctagagatagagtatcttttacttataccaatgaatggtagccataactaatatgtattttactaatcagaacaaatgttctatactaattagacaaagcaatctacaattttttggaacgttttcccattagacgtgtgatataataaagaaaaatgtcgatgggggatgattatgaatttgcatcgcgttagtgaactgttgattaaaaatgatttgactcaggcgctatattttgtaaggaaaaagaaagagggatatatttcttattcaccggaagttgatcctactatattcggaacgttgcgtgaatacataagaagttatattgaagattttcaagaatatgagcaggtagaatttaatccaacggggtatagggatggaacaatcgagacttgcaatattgactatgttgggaatttcgaagaagttataggaagtcttgatattggtaacgtggaagacgcagaagaagaagcagacaatttttccttttattgcttgagtcttgaagataatgagggtaatagcatcaaattgtttagacgcgttacaaagtttaagcgcctttactctaaaggactgatagctgcattccatggaaatatgctgaatcgaatcgatagtaaaatgttggggctcgatgggcaaatagatattatcgtatttgaagatgagattgcaattttaagtcatgtggctttggaaagaatatttcgtttaaatgagcaatttgttaataaagcgcaaactgcaattgaccgcattcgttgtgccgataaaattataaatatggatctatttgaagaagattgtatgaatgacatgagaatccaaaaggttttgacaaaaatgcttaaggaggaaaatgacttggaaaattgttttgacaattttagtaacgttgttgaaactatagagttgtttgagttacaagtagaaatacaagcagttccaagagaaggcataatttatgaacacaaagggcaattaatggatataataagattagctagagattcttattatatgagcttaataaaagaaaaaccaggaattgataataaaatttagggagtgatgcaaaataaaacgattgacagtaaaaatgtctatgtttatttcttcttatttcccattgtatattatgcttcttatcttgcattttggtaaattgaaaacggttttcgacgtattaacaataaagaaagtcgcttttttaatatgcatgggcataggtattttagtatctctgttaagtactttgataattctaagaggtactggaacaaagcaattaataattactgagttggagcgaccagatgatacaattataagctatatgatgacttatattattcctattctatcaatagattttcaagattacggagttattgctgttaattttataatgtttttgttgataggatatctgtatatcaggcttaaccttttatatcttaatccgttgtggtctatcgcggggttcttggcttatagggttaattcagaagttgtggtaatcacaaatattaagtatgctgaattaaaaaggattaataagttaaagggttattatgtagcgaatgacattttcattgcacgaaaggaaagtaataaagattgaggcacccacccggtgtctcttttcttttactgctatcagtgatatgataaaagaaaagcaaaggagatagctaatgtcaattatgatgcttgcaggcgtagcggttgccattatagtagtaacggctattattatagctataacaagaagatagattatctcagaggcgggctaccccgtctattttccttgggtgaattatagtaaaatgctgaagagcacgctgattgcagaacctggaaagttttacttctggatagagataataaaatggttgtggagccgttaacacttacaccagatcaggaataggtgatgcaatatccttgcttgaaatatgctaattataaaagaggttgagtatgataagattagaagaatacatagccaaaagaaaaatggaagatcatctaaatgaatttgatatggagctaaaggtaagcaacattaaaaagtcaattgaatacatatttgaatatttcagcaattatcttcccttggaaggtgctgaagatcactcggcagaagaaaatgaacgaataaataaatatgagaaagctcttagagagtattctcccgaacttagtagatggtttgtgacaatatatgacgaaacaggtcatcaagtaagtaaaaccatacaaaaatactgtgataatacatctggttttcttcttacatttgaagatagtgaatttcgcacaatatcctataattgctatgctgagttgataaagaaacgtccttgtttaagagatgaaacagagaggttataccagtttataaaagaatatcatgctgtagttacaaaaagagaatatgagtactttggctttcctcaaatttccgaaaagattaccacatggcttaatgatacatatatcaagtataatgtaaatttagccgttgctattaagaagtatttgacggaagaattttataacaatgtagatatgttgccttctggtagcaaaaacaaatcagatcacccatatagaggccatatctataaatataactataaaaatagaacaaatttatttaatataaatggatattatagtagatttggaaacaaaccatttttgaatggtaaaaagaagtctattgaaattttaatgatgtttacatggcttggggatgttagtggtgaggattctgatttctttcaaaagtatttagcagaattcaaagaatattgataattgtcaatcctaagttttagatcattggtgtatcaggtatcatggtgtctaaaaaagtgtttaaaataagacttttcgcttgaattcccctccccatctggcattatatttataagcatataaaatattgacaagcactccaggacgcaacttggaggatataacaatgcgtaggaataggatagtccagttttggattgcctgttcctacgctttttgtttgtaaaaatctgataattgagcaaggaggtaagtgctttaattattaatcccgtggaaaatgcaaattatcaaaggaaagattaggtgtcatttttactttgtggatttgagctgatcataccatactttacgttctatttctctttcagttatactaaggatggcttttatataatcctgaaataattgatataattcggctggtagtaaatctatggttttgccatccgataagcggattatttggctagagtgctcttctactaatagtgtcttctgcagcacctcgacaaaagatggacaagatggattactttttatgtttttaaaacgtgtgatatcaggacataatttaatatctaagtcatagccacaatggtgtagaatggccttgattccattttttaatagagtatctatatctttttgcggaggtgtttcgaagtgctcaaatttagtcttgcaatctgtttcacataataaatatctataatcaatatcatcaaaatcatcataaccaatggccacaaagccattttcaacatcatcggcatattcttccttatcttctgcagaaagttcacggtaaggcatttctattaactgcgttttagttggagatgttttgtttaaataatctgcaatagatattgccatatctttggtcagacgcctttttccattgataacataacttatatgttgcggtgtatagtttaattcttcggcaagttcattgctttttatattacggtccctcatgcattctttaattctttcgccctgaattctacgaatatatgagttttgatcattattgtccattatttatcctcctaggctcttaactttatatggcgtacatttagttgatggctaaaagttaacatttatgttactataatactataaatagtgactgatatcaatcattatttaaacaaagttaaacagaaagagaggaaaacaagatgagactaagggcaatgaatacagtatcaggagaaagccgtttgatggatacggaagagttacgagcctacacaaacctcgggcgtaataatgctatgaagttgggtgaagagattggggccaaggtgaaagttggaaaacgcgttctttgggaccgggtaaaaattgatcagtacatcaatgaattaacgggggcatgactatgcaggaagaaaaacgcacagggctaatggaagaagcccagaatcacacaccaatgcaggaaacggcggcaaccgtagaacctgacaaaaccttaccgtttatagttatggaggctttacagacaggaaaggaaaatgctatcagcgcacaggaattatgtacataccttaagtttgataatgtccgggaactgcaaaaggagatcgcaagagagaggacggccggagcagtaatactttctacctgtcacgatggaggaggctatttcctgccgagcagtgaccaggaggtgaagcagtttataagaacactggaaagccgagccagaaatacctttgcggctttacggtcagcaagaaactatataaggcaacagggggaaataaaataaatggctaataggcgcatgtttagtcttgacgtggtggatacggataatttccttgagatgtccgccactgcgcaaaacttgtattttcatttggggatgcgagcagacgatgacggatttgtatcatcaccaaaaaaaatagcaaaggtagttaattgcggtgaagatgatttgaggctactcgtcatgaaaggctatatacagccatttgagagcggagttattgtaattcggcactgggggcagaacaattatattcagaaggacagatacaagtcaacaatatacataaaagagcgtgaaatattgagggttgacaatggaatttactctctggatacagactgtatacaagatgtttccaaaatggaagcacaggttaggttaggtaaggataataaaagctcttgtgcagcagaagccgcacgagatactccagtgcttgaaaaacagagagatgatttcgagaaaatttacaccatatatcctaaaaagcggggaaaggcaaaagcatttgaatattatcgcggctttgtcggaaagaccgggaggctgattaatggtcaaaggtatcgcctggaccggcggcagatatatatagctgttgccagctatgtgaatgaacggcagcaggaaggaaccaaagtcgaattttacaagaactttgataccttcatgaacaagaatatccttgactacatagaggggagcgaaatatgagcagattagcagaacgatcaattataggtgcgctgctgatggatatcaactcaattaacaccgtttatgatgaactcaggccggagatgttccgggaggaactataccaaaaagtttatattgaaattgtcaggatgtatgatactggtgaacgaattaatcttgtaagtctgtctcagaggctacaaggatatggatatcctgaaaacattatccttgatggactgagagagtgtatcaactcaacaatgaccacaacagagataaggagttatgcggatgtactgaccagtaattacaaggctgcacagttattggctatattaaactctgttaaagtattgccagttgatattgaaaaccaaattggattattaatgaatgaccttgaagccctgaaaagttcagaacatacaaagctacggagcatggtgcagattgtagcagaacatgagaggagccactttgcagagcatgaatcaaatggtatcaaccttggattcccccggctagatgatatgcttgtggaactggaaaagggggacataacggttataggtgcgcgtccggcagttggaaagtcagcgtttgtgacgcagattatccggagcctgtcaaccagcggcaagcgtggagcattttataacttggaaatgtccgacaagcagatttatgagaggatgctatcgtcagaaaccggtatcgggctaaagcggatacgaaaagcgcaggcttatataggtgatgaacagcccaaggtgtccgcggccaacagcaagattagtcagtatcaggtgatggttcgcagcggctcggtgaagccaaccgacatcaggaatgaatgccgacatctggatttggattacatagttattgattacctgcaattgatgaaatctgatacgtggtatagtaatcgggcaagcgaagtcggtgccgtatctaaagcgattaaatcacttgcgatggaattacaggtacatataatcttattatcccagctaaaccgggtaagtgaaggcagggataccaaagaaccgtcaatggcagaaattcgcgaatccggggacgtggagcaggacgcaagtgctataattctgctatggaatactgatccggatgatatcagtcaaaagggaatcaaggttgagaagaaccggcagggcgaacttggcaaaatacctttcggattcgatggggctacaatgcagtttgttgagagagaaggtaccataataatgcaacaggaaggctttaaaaggactaaaaagacaccatttgatgattaggggaaaaaatgttgaagaatgagcaattacagcaagaatttgatttatttgcagatgtgtggaagttattcaaatatgcgcagccggtcggctccaggacggatgttaaatattgggattctgtaaatcaaaaagtcatcgagattatggagaaatatccaggcgaatttgcaacagaactatctttgacaatcctaaacgaactggaaagaaaggggaatctttatgaagataaggacacaggatgcaaggcgattccttgaattaagcgagtgctatatcgaagattgcatgaatgggtgtggtatttacgtaaagagtcgctacagccgaaattcggtactggctggaaagtatgaagacgaagctagggcaaaaggggtaatgcatgagatttgtatcgcagagtccaggctggagcggattttctatatgccgtcggactgacaatatgttaactttttaaacatttgggtgtggatgttgataaggcaatgagatagggttttactggaagtgaaattcgtggttactgcgcgctaaaaggtagtaaccacagaaaaagattgataggagaaaaaacgatggaatcagtaaaagatcaggctttaacagcaatcaaagcaaggagggatttaagtccgccattgatcagcgtgtataaccttttaaaaatagacaaggtggaaacatgggccggattatgttgtgatcgcatagcagatgcaaatctgattgacatggaggacgtacaaatcgattttattaatatgccaggactttgtcttactgctaatggaattatgatgtgtcgggacattctggaagcttacattggcaaagatactcttcgtgatgcattcaagtggatgtgttctaaggaatccataaatgccaatattaatattgctgctcaagtcttgcgggatatgagtaattcgcgcttaacagagttgtacagggaagcagagtcattacaattaccagaatgcgtcagtgcccgggagttgattcaagaagagatgcgtcagagactgccttttatggcgctggttcgcaaagtcagaaaagaataccggctactgcctgttaggcggattcttttaagaacaaaaagcaatcagtaatgggtagtaaaaggtgtggttactacagtttataaggcagtaactacgggaagggaaacggatgtactgcgttattcaggaaattgagaaaaaaagtgccggtgggtgagccaaaggaaattgaagtacgtaaaaccaactggacgatgaatggagaatcttacacctcttatgggtatcaatatagccaagagtgctatgaacgccagatcaggaaggcttaccgcatcagtatccataaaagtttccgggaaggtggcagagtttgcaaaaagcaaacagtaatatgcaccattggatattatgatctcattgattgtagtagctggatcggtgattacataagtggcagcagatggagtgataaggttaaagaaataggcctgccggaggaagaacttgtaagcatgatttatgagaagtttcagcccatcgttgatctggtagaagcagaatttcatcagacagaggaatataaggcgaaggaagaacacagacgtattttaaaggaatatcaacagagagttgatgaattcataaaaaagtacgaggctactgagcgtgattataagtgctgttatgatgtttttggaaacctgatgaattcggattctctaaaaagaatcgaagagaattataaacaaaggcgtgaatatgagcgtaggagccaagaacagagccgtagttattatgaaaatttctataataactacactggaagcagttccaacagctatggttccgcaggcggtcaacaaaatgaggcgagcaaagccactcttaagcagttttaccggacactttcaaaggtatatcacccggatagcaaccctggaaaagatacatctgaggaaatgaaggttcttaatcagcttaaaacggagtgggggtgtagtggtttgcagcagtatctaaatcaaaggctcagaccttgaaaataaaagaggaaaggaacttaaaaacatgatagcaattggtattttattattcgtaattatctgcgaattagcagcaatctacgaaaagatggaggaaaagaagcatgaataatacacaaaaccaaagggatatgatttcaatgtgcttaggtaggttaacggaggcagtaaagggttttgaacctatcgtgaagcaggtagaggaggccatgccttacgctcttaaggcaacatcggaatctctgcagaggggagcagaaagcctgagagaacaaaaggagcagtacgaagcagcaatgaagcaatatgagaaagcaatgatggagggaaatattaatgagtaataaaatgcaaagtatcaatttttcggacggttataaatctttctgtattaacgatgacccggacagggtaatccggtttaacccgactgatattgacatcgtgaaacgatttaatcaggcaatgaaagaactgagagaagaaaaggacgggctggaagatgtaagtcttaatccagatgggaccgttgtgcttgatgatgatgctacattggaaaagacttcggaagtactggagcagtttaatcaggtaattcgtgaaaagctgaattttatttttaaatctgacgtatatgacaccatatttgacggccaatctcccatggctattgtgggaaaagaaagacaactgctgtttgaggcatttatggatgccgcttttcaggtgattaatgaagaggtggagaaagccaccagggaaagggttggcaagtatacggcgaaatataagaaaaaagataaccggagttgaggaaacatgaatgaagagatgcagaaagtgatagaagaaatacatagccgggggaatacggtggaaatcaaacagcgtaaagatgatgttatcattttggaagtagttaaaaaaattgtatataagtatgacaggcaaaaaggtgcttgttaatggctaagtggtgccgatggctttcagaaatgggagctgtcggcctttttatttaaggtggtggaacatggagcaatacgatggctcagtacttattgattcgaaaataaatactgatggggcagaaaagggaaccagaaatttaaaatcagaatttgaaaaaatagtgtccagcgctcaaaaggcgggtgacagagtaaaagatgttttctcaaagtccatgaaggaagtagggcaatcatcacaaggtgttggctccggttatgatccaaaggcaatggaaatggtatttggtaagtctgcagctcaaatcaggaactatgcgcaggcagtccaactatatgggcagcaggcaggacttgtaatgaatcaaatagatgttgaaagccagcaggcggcctcttctttgggaaacgtatcaaatgcgggaaagcaggcagggggagcattgaaaggaattgccagtggagggaaaacggcttctgattcactaaattcaacagcttctgccggtcaggcctcaatggtaagcctgaaagattctgttttatggggaatgaacacagtaaaaaaaactttgatttctacgattgttaatattcccaatattgtacgatctggatttagtaagcttcctgttattgcgggagctgcattgaaaggtatggcagcagcaggaaaggcggcttttgcttctcttggtaagttggcgaagagggcatcaggacagatgttaaaccttgctaaaagtgtaatgaagtcagtcgggcaaattgcaagatctttgttaggtcttagaaagaatacacagaagacagggaaaagctttaacttactgggtatgctttttcgtacacttgtatttagtgtgttttaccgggcaattaatggaatcacgtctgcggtaaaagagggaattgataatctcgcccgatattccgataagaccaaccagacaatttctgaattgaaatcatcattaacaacactaaagaacagctttgcggcagcatttgcgcccatcatagaatttgtgacaccggcattaacaaggctaatatccaaaatggtggagctaaacaactggatttcgcaaatactgtcagctctggccgggaaagatacttttgtaaaggcggtacaggtacaagaagattatgcagcaagtcttgatgcaacaaaaaaagctacaagggaagctgcaaaggaaaccaaaaaggccacatttgcatttgataccttgatacaggcacagggcaagaatactgacaaagaagaatacaccggaccgtcaccggatcagatgtttaaaacagtggaagttgcggagaatgtacagaaggccgcagacaaaatacgagaattgttcaacagtgaggatttctccggtattggggaattattggggcaaaaaatcaatgcagcaatagcccgtatcagttcattgattgactggaataatgtgggggataaaattactcaaatcgtatcaaggtttgtaagcctgttcaactccatggtatcaaccgttaattgggactccctgggaagaatggtgggtaagggcattaatacgattgtaaacaccttatatcttctgttaaatgggattgattgggtgaagttaggggaagcattagcaaaaggcctaaatgggcttatttatgaggtggattggaaaaaatttggcgctacaatcgggagttttatccaggcaaacatagacctgttatatggttttgtgacaactgcagactggccggctattgggaaagctatggctgatggcataatggggctgataaacaggattgattgggcaaggtttggagaaacgctgggaaagaccatatcaggaattataagcagcatacataattttattcaaacaatagactggacagggttaggacagaaaatttccactactctaaacaatttctttgcaaatattgattgggcagatatgggtcagactttgagtgattttgcattgggcctccttgaaactctgcgtacagcattaaaagaaactgactgggaagctataggccaggacttaggagaattccttgtaaacgttgactggtggagcgttttcacaagtgttgttgatgtagttgcccggatagctttagcagtggtaaaggccgcatgggcaatgctgaaagtggtgggaaaggccctatgggatggcattacagaaggaattgcagagttttcagaaaacccgggagaatggatcaagaaacatattgttgaaccattcataaaatggatcaaggatttattcggaattcattccccgtctacggttatggctgcaatcggcagatatttaattgagggattaatacaagggcttgagaattcaatgagtaatcttgttcggccactgacaaatctatctgaaaagattaaaaatggctttcagagtgcgtttgacggtgtgaagaatattgcggcgaatgcaataaactctataattgatattctgaataaattaaagtttgatgtgcctgactgggttcctgaaatcggcgggaaatcttttggatttaatataaagcatgtggctttctctggaagtggcttttcttcctctggttatccggcatctgcctacgctgcatatacctcctatatgccccggcttgcgaccggcacagtggtgccccgaaggccggagagttcgcggcaattctgggagacaacaaccgggattatgaggttgtgtcaccgttggggacgattaagcaagcagtattagaagccattaaggaagcgggcggaattggcaacggtaccgcaaaggcagacttgatcattgatggcacaaagttcggccagttagtttataagtacaacaacaaagaaactgagcgcgtaggcgttagaatggtaacgaatggtgggtaagtacctcccaaaatctcattttctattttagtagaagtatttgaattgaatggggaggtattaagatctggctgaaagttcagtgagaaactatcttgcaaagatgaataaaaagcaagctattatgctaaagacttcggatgtccatatcttggacatccgaaaattaaacaacgcaggtgaaaaagttcttaccgaaacttcaatgataaacaggttttaatggttaaaatttagatatgcataatatgcacatccctacaaagctatgaaaggcaggttgctcggggtgggtgagccgaaaaccagtcatctctcgtactgtttgagaatgatgttgaaaaaagtttaagtttcaacctatattgttaaatgcaaggaggcagcaggacatgacaaacgaggaacttgtaatcaggatcaaggctggtattgatccggcggagaatatgcttgccctatatgagcaggtaaaggcctttattaattctattgcctggaagtatcatggacgggaagaaattgaggatttagagcaagagggctatcttgccttgtacgatgccattgacggttatgccccggatactggctataaattcctcacctatgcaaagccctggatcattcagcgcatacagcggtacatagaaaattactcctgctgcctgcggcttccttcccatatacaggtcctattaaggcaatataagcagtttcatgattctttcatgaaagaacatgaccgggagcctgcagaggacgaaacagcctatttcatgggattaagcatagaacaagtaagggaaatacataaaaacgccgctacggcaaatatgacaagcctgaacgcacctgtaaagaacctggaagagggagaatacacggtaggagatgttatcccctccggtgaggacatggaagaggatacgcttgaacgcattcagcaggagcagcttagtgcggtgctttgggaaatggtggatggcttgccgggcagacagccggaggttatacggaaacgctatcaggacaaaatgagtatgacggcggcaggggaagaaatgcgggttgggtgcagtgaggttcggaaagaagagcttaaagcattgcgagaattacggaagccgcataatgccaataaactacggccatttctgccggagaatgaggtgatctacaacatgggaataagtggaaccggatttgaaagatttaatcagacatggaccagtgcaacggaaagagcagccctcagatttgaggggcgatacaaataaaaatttatttgtagtcctctcatgctttttctgagttttgagttttagcatggatgactgacgtaaagtttaacgtcagtgactattttattgaaagctcagactttcattatcatggggaaaatgattacctgcgcactttaatatattttgtcttgtgatatactggaaatatacaaaaaaaggagaaaaacaattgtggacaaacagtttctaacaattaaagactgcatgaagcgccatgggaagagctacgacacaatagcaaccttgttcaagaaaaaaggatctcctgcggtgcgcgttggccatgaatggcaagtggatataaacaagtgggaccagtatctgcttaagctcgcagaagatgacaaaggctaaccacaggtaccgtggacatgccagaacattaaaagaggaggacacatgaacgaattaactgtaacaggaaaacagaattttatgggaattaacatcccggtagtgcttggaggatttggtaaggacaagaagtgcttgtctgataagaccgttgcagagattcacggccagccaaattataaaattagagaacgcatatcagataacattaagcgttttaaagaatcagttgattacattgacttaaaaaaaggtatccgtgaggcggatacgttagaaatcctcttaagcttgggttatgcaaagcagtctatcactcaggccgatcacatttatatgttatcagaacgtggctacgcgaaactgattaagataatggattccgaccttgcatgggagattcacgacagattaattgatgaatactttgaactcagagaagaaaagaagcaggcaaaggcccgcgccgaacgcctcgccagtgtcaacaacgcggtaaagattttcactgcaatgttggaaaaggcagtaatggcacgaggtaacgattcgttaggtcatcgaaggaagatatcctaaatattcgggagccttggcagtttgataaagagtaaagtggaggtaagaaagatggtagagccatataaaccgctgtacacagttcgggaggctgcagaactcctcatggtaaacaaagattttgtaaacagggaaattacccaagggcggcttccatctttaaatttgggtcgtagaaagattcgtggaagtgacctggaaaaatacatagaaaactacccggcagacaatctggtaataaaggagggcgagatgaaatgaaagtatcgtgaaaagtaaaaaattaagtttgatatatttacatgaagacacaaatcaaggtaacactgtaaaatattaatctcatgaagttggtgaaagaaggaagatatgcattacattgacataaagagcgtaatggaagttatgaaaggatcagagttatcacggacagaccaatctaatgcatacctttccattgacaatcagccgttccatgtaaaaataacatatcaaaagaccggatttggagaaaagccttttctatgttgtcctaaatgcggcagcaggcgtgtaaagctctatctgtattctgaaagactattgtgccgggaatgccttccgtattcgctttatagcggtcttacacatacaacgaaaggcggccacaaatacataagatatcgaatgcagcggttggctgcccgaaatgggattattttaaagggaccgtttcattatgacgaatatccaaagccaaaggggaagaatgatgatgcatgggaaatgattcttaagaagcttcagggattggaaaacatgcgaatccaggccctttctttcaataagagatattcggataagacaataagaagtgtgctgctggagaagaatattctgctttatgtccttgacctgtatgacattgatagatacttttataactgggataaaggctatatagattttccggggaatccaaatgatatagaggtgtcgggaatttttagtaatgtgaacgcataccagagtgttgtactagaatcgttgtactaaaatcatcttagtattttgtatttttgaaaaacaatccaaatggtgaaaatggtctttaatattgatctttcggttattttgtatgcatcttttgtatgcagcgcaaagcgaacgttgcaaacgttcggtaatctcgtggcggaaaattccgccgccaatatataagctggtacggcaattttgccgactcagagcaatcaagagtaatatactgtttgtaggaaaatgttgacatttgttggtgtttcaacctatatagcgggaataccccatatagcgtacagacggttgcaaatagttgcatgattaattatatagctgatgggtccgccatgaacaaaatatttaaataaatgatgacttatgatgccatatctgtacatatagcggtttatttaaatggacagcgaatgttgaagaatgttgaggtattttcatttatagctaaagtaccaagaggaagtagatacagcctgcgtagaaaatctcacggcccccaatttagtcgctagataattcttttaaatgagcttatcttatagaaccttcatcaatctaaaatgttgacatttgttgacctatcggcctatatagttacttcccaataagaaagactggggaagaaacgaaacgttacaaccttttaaggcagactacaatgcagccggggacctcagaaaacctcaaattaaaacctatatagtggaactttctttttacttgattgcatagaaagtagcgttaaggaaaacagtttgaagcagctgggcagcaggtcagagcggaaaattgcgttgtgatgggatacttttacataaggagatccgtatagaagcaaaatcaaatagaatggaaaattccgttgtactgaaatacctggtagttcttgtggtaaagaattcggactcctcaattttgaggagtcctggtggagttctccatttgcggagaaaagaaaccaaattaagcagagccgaaaattcagctgagtaaaggacaacgcaatttcgcacagtcaggaagaagggaacgtcaatatgtcacccacctcttgggggagcatattgataaatagaaagaaagagaaaaaaggagtgaattcgtgagcaagttaatgatgaaagcgtcggaagttgctgaaatcatggaagtatctgaacgtactggatacaacataataaaacaactaaacagtgaattagaatcaaaagattttttaatcaggcctggaaggattcccaggaagtatttttttgagcggacgggtttggagcttacatctgaatcgagagatgagtaacctcatgcgaattcactttaaggcatcaggcaattattggcggtatatatacgtaaaataatatattagattataaaaattaaaattcaatagagaaaatcacagtgaaaaaaagtcatgcgatgcaacgagccgatgaattaaaaatacttatagccacagtaaaaatcaagcacaagcttacgaatgctcagctggcgaagaagctcgatatccctcttagtactttcaattactggaagtcacatattgaaagattcccggccgggaagatatggctattggaagtaatggcagaaaaataaaaaaggtggcaatatgatcgatttaatgatctttgaaggaaatgaagtagaagtatttgaattgaatgaacaggcgttatttaacccgtatcacgttgggaagtgtctggatctgggtgaaagctctgtaagaatggcaatatccaaaatgaacaagaagcaggttattaaggttactaattctaatgtcaaagatattgactttagaaaattacacaataccggagagaattttcttactgaaagcggattatgttgatttaaaaagtcgtgcatcagacgcacaacaattattaacatcactgggctatagtaagtcataaaactgaaaaattcagatgtgacaattagtaacttccgaaaactgaataacgctggagggatcttcgtacacataacaacgcagtttttgcacggcccagataaaaggatagctaaattttgagctgtcagggcggagttctccaccatgggattgatagcttagttgcccgtttgcttgatggatcaactatccctcgaattgagggagggtcaacaatatagttgaatggggtcacggattgataccccttctggtaaccgaagatcggattaagggattgttcgcacctttgtgtgggaagtacgaaaagcgtaccgctggctttgtggtaatggccagtatctaaaataggatagtcctcatatatggaaacacctggaatagaatgggaaatcaacgctgcttggtttagtttctttcagggctggtaaacaggcaagcgataaggaataggccattgacatgcgttcgtggcaaatctcgcttaaggatattgaaaggcaggaaacggcaaatgcagagcacatagaggcactacagaaggggaggggaagaaaacggcagcagaaccgttgtggcctactgccaaaggggagatagttacaaattctaaagttgctaaatacaacgttagctggtaagggccagctgtcggtaaaagtaattgcacattgaaatgggatatgttaccatagtggcatggaacaatcgtgtcactgcaagggcgttggccttccatcatacatagatgggaggtggtgcggatgaaatatgactttaaagacctgatggcctttggtatgttcatagtcgcattacttacctttattttcgttaattgtaagtagcgtttttctataaagtcctggaaacaggcatagaaaaaccacccttgtaaactttggtcggtttgagggtggaattttctatcttattcatggccaaccccttgtagggggcggttgttccttttgtaattctaatatagcatatctgcaattcaaaatcaagagcttacaatgcaattatgggcagtcctccttgtcataattgttcttccggtttaaaaaatccctccaactccattctcatatcaattgcttttttgatatagctgtttatcttttcgttagatgcctcagcagcagatttgatattatcgtatttgtccctctgaacgtcaagagggatacgcttaacattttctttccggtatttcatatttgcgcgcttttgtgcttcggttagtgtcatgcttcaccgcctttcatactattgtagccatttggacattaaaaatgatgtcacctactccaccttacaataagagtatagcataaaatcaacaatgtgtacacatataaaattacacaaatatatacgtacacatttggttaatatcactattgatatatgcgtacacatataatataataagtacataagataacaaaacaacaaagcaccgatacccccgaaaaggttatgaaattccggtcaatatccctgtgagtgagccaaggcaaaaccaatagtcaggaagattaccggaacggtacaaggattcaatcccggtgaggaggtgccaagactggcgaacaatagcccggtaagaatccaccagaaggaaaggagatcaactacatgggagaaagagccattgtaaacagagtaaaaaagttaaaggccattgaagagcagcagacagcgcttaaggcagaagcggataagctgaaagaggaaatcaagaaggaaatgcatgcaagaggagccgaggaattaaaggccggggctttcctggtacagtggaaaacaatcatcaagaaccgattcgattccaagagcttccagaaagagcacaagacgctttacagccagtacatgagtcagacaagcgaaaagcggtttaccgtagcataacaggcctgtaagtgctcagggccaataaaagaataacaagcagcagtgagtaacggcaattacatggacctgctgccagatcacacaccaaatgtaaaaaccccatgcatcggcaaacgcacagggctaataaaaaaattcaacccgttcacacaccatgcaaaagggatactctgattatagcacagatttatccctttgcaaccccaaatgtaaaggagaggatttggaaatgacaagagaagcgattattgataaaaaaatcttggatattgagacatcggtccgaaaaattcaagtgatgattggtgatttatttgaaagctatttttgcgaagaagtcatatccgaagtggatacatggaaaatcttgtctcattattatgacgatgcaggtgtgaaggtttgtattattggtgatttagtgctgaacctttgtaaaagtctggaagaactgaaaaacgccgtaaatattactggtgaagcagaagatactcatgtacagtttccagagggaaaacagggggatttgaaatgattgaagaaaaaagatcaacatataaaatggttgagctgttatgtagtctcaatttagaagaacttaaagcccttagaccgctattgttaaaagaggtcgagaagttgggcggtggagatgcattacagcagtgtagtaacaaattaatagatttattaatccacggtaagcagacggaaatgagggaagagtatgcagaaaatgattcttgtgcctgttgagcagtacaactgcatgatagaaaactatgacaaggctatggaggaattacaagaggtaaaggggcagcttaaggccataaagcaccaggacgatgatgtggcccaggaactcaaattgtatgagattatggataagcataactgtgatcgggacgttgccgaacttcttttccaggatcaagaggaaaaatagagagaaccttcatgttgaaaaatattgagggaatgcagcatatagcaattatattgttgcattccttataaggagtaaaataatatggcagtagataagaacgggaagccgttaccgaaagggattaccctgcgttctgacgggagatacatggcccgctttcagtatgatggggagaggtataccatatatgatataaatatgaaagacttgctggagaaaatggaaaacatgaaatatgagttaaagcatggtattttctgcaagcctaaagatattacggtttctgcctggtttgaaacatggttggaacaatataagaacaatacaagcaaagcctcaacgatacagacgtataaacagacatattcaagctacattgggccggttttaggaaaaaggaaagtgacggacatacagccccaggccttacagaaaatcattaatgacctttacaagaaagggttttctaagtcacgtgttaattttgcatttgttattttatcgggaatgttcaatcaggcacaaaaaaataagctgataataagtaatccggctgacgctttggtttttcctaaatacaggaaaaagaaccagaatgaaaagagagtaatgtcactggaagagcagcatacttttttgaaatatgcaaaagggtctgtatactataatttctatgtaatggctttatcaacgggcatgcgtgtcaatgagataacgggcttgcaatggtctgatattgattggaagaataaactgatccatgtaacagggaccctggtatatcttcgtgagggatcaggccggtacaaggatagcccgaagacagagagcagccggagagatataccaatgcttaataatatagaagaacttctgaaaaatatcaggcataggcagcttgaaaaccggttaaaactgggcgaaaaatggaaagaagaagataacctaaaaaatatggtcttaacttatgaagatggtggagcattttgggatactgggatccgggtagacatgaaaaaaatcgccaataagatcaagaaagatggtatggaatttgatccgataactccacataccttacgccatacatttgccacaagaggcctggaacagggaattccgttaaaggtcatgcaggtgatcttaggccatagcagccttgccatgactgcagatttatattcgcatgtactgccagatacgaaagccgaggaaatgaaaaagatcgaaaaaatactgtaaaaaaatagaagtggtgtcaaagtggtgtcaagtcaaaaaaagaggactatccaaattattttggaagccctctttttccttgtaaataaaaggtttagagcagataacgggaatcggacccgcctcctcagcttgggaagctgatgttctaccaatgaactatatctgcttagtgttatttgacacgttttatattatagcatagggggtcaggaaaattcaatacttttttatgaaatttagcaaaaaaattgccagtaacttgccaaatatggaaaaggcattgtataatgggaaatgacaatactagatgtggaggagtatcatggcaaaagcacagtataatgcggacagtattaccgtactggaaggtcttgaagcggtgcggaaacgtccgggcatgtatataggcagcgttgggacaaagggattgaatcatttgatatatgagattgtagacaatgcggtggacgagcatctggccggttactgcgatcagatatgggtgaccctggaagcagacgggtcctgcaccgttaaggatgcaggccggggaattccggtggaaatgcacaccaaaggcgtatcggcagagcgtgtggttttgtctacgcttcatgcaggcggcaaatttgataacgatgcctacaaaaccagcggcggtcttcacggagtgggctcttccgtggtaaatgccctgtccgcccacatgaaaatcaaagtatataaaaatggtctgattcattatgatgagtatgagcggggcataccaacggtcgaactggtggatggcctgcttcccacgttaggaaaaacaaaggaaacgggaacagagatcaatttcctgccggatggggagatctttgagaaaacgcgttttaaggcggactggctgaaaagccgtcttcatgaaaccgcctatttaaatccggccctgagaatcatctatatgaacaaacggcagggcgaagaggagaccatcgtctatcatgaaccggatgggatcatcgcctatgtaagggaattaaataccggaaaagaagcagtccatgatccgatatattttaagggaacaatggacaaggtggaaattgaagtggctctgcagtttgtggacacctttgaagagaatatcctgggtttctgcaacaatattttcacccaggaagggggaacccacctggcaggttttaagacccgtttcacccagatgattaacacctatgcaagagagcttggtgttttaaaggaaaaagataccaactttacaggagccgatacaagaaacggcctgacagccgttgttgcggttaagcatccggacccgatttttgaagggcagacaaagacaaagctggccagtgcggatgccactaaagcggtattcaccgtgaccggcgacgagctgcagcggtattttgaccgtaatttagaggttttaaaagcagtcatcagctgtgcggaaaagtctgcaaagatccggaaggcagaggaaaaagccaagaccaacatgctttccaaatccagattttcctttgacagcaacggaaagctggcaaactgtgaaagccgggaggcagaaaaatgcgaaatctttatcgtagagggagattccgccggaggctccgcaaaaactgcccggaaccggcagtatcaggccattcttcccatacggggaaagattttaaatgtggagaaggcctctatggataaggttttggcaaatgcggagatcaagaccatgataaacgcctttggctgcggattttccgaaggctatggcaatgattttgacatttcaaagctgcggtatcataagatcatcctcatgactgatgcggatgtggatggaagccatatcgatacccttcttctcacttttttataccgctttatgccggagctgatttatgacggccacgtgtttatcgccatgccgccgctgtttaaggtcattcccaagcgggggcaggaacagtacctttacgatgaaaaggagctggagcgctaccgcaggacccacactggggaatttaccttacagcgttataagggccttggtgaaatggatgccgaacagctctgggaaacgacccttgacccggaacggcgtgtgttaaagcaggtggaaatcgaggacgcccgcatggcttcggaaataacggaaatgctcatgggcagtgacgtgcttccaagacggctgtttatctatgaacatgcggatgaagctgagatagacgcataaggaggcgatgaggaaatatggcagaaaaaatcattaaaacagaatactccgaggaaatgcagaagagctacatgaactattccatgagtgtcatcacagccagagcgatcccggatgcaagagacggattaaagccggtacaacggcgtgtattatatgatatgagcgagcttcgcttaaaccacgataagcctcacagaaagtcggcccgtatcgtgggtgataccatgggtaagtaccatccccatggcgacagctccatatatgaaaccctggtggttatgtcccagatatttaagaagggaatgcctctggtaaacggccacggaaacttcggttccattgaaggggacggggcggcggccatgcgttacacggaagctaggctggaaaaatttgcagaggaagtctatttaaaggatttagataaaacggttgactttgttcccaattacgatgaaacggaaaaggaacctgaggtcctgccggtccgggtgccgaatctcttaataaatggagccgaaggcattgcggtaggaatgagcaccagcatcccgtcccataacctgggggaagtcattgacgcggtacaggcttatattgacaatccggatatttccatcagggagctgatggaatacctgcctggtccggattttcccacaggcggcattatagccaataagagcgatctgcccgccatttatgaaacgggagcaggaaagatcaagctccggggaaagattgaggtggagctgggaaaaaggaaagcggataaggacaagctggtgatcacggaaatcccttataccatggtgggagccgggatcaataaattcctggtggatgtagccgagctggtggaaagcaagaagctgggggatgtggtggacatttcaaaccagtccaacaaggatggaatccggatcgtcctggagctgcgaaaggatgcggatgtagaaaaaatccgcaacatcctctataagaagacaaagctggaagacacctttggagtcaacatgctggccattgcggacggcaagccggaaacgctgaacttaaaggggatccttaaaaactacctggatttccagtataaaaatgccaccagaaaataccagagtcttttggaaaaagagctggaaaaaaaggaaatcaaggaaggccttattaaggcctgcgacatcattgacttgattattgcagttttaaggggttccaaaaacttaaaagacgcaaaaaactgcctcatgaccggagacatttcaaacatcaatttcagggtcaagggatttgaggaggatgcaaagaccctgcattttacagagaaacaggccacagccatattagaaatgcgcctttacaagctgatcggcctggaaatccttcagttggaaaaggagtataaggaaacgttggctaaaattgcggaatatgaaaaaatcctctccagccggaaaaatatggacacggtgatcaaggatgacttagcccggatcaaacaggaatatgccactccccggagaaccttgatcgaggacggaaaagaagccgtctatgatgaaacagctgttgccgtgtctgaggtgacttttgtcatggaccgtttcggctactgtaaggtcctggataaagcgacgtatgacagaaataaagaaaccattgaaacagagaatccatatgtggtaaactgtttaaacacggacaagatctgcatctttaccaatacaggaaatttgcatcaggtgaagatccaggatattccaaacggaaagctgcgggataagggaacgcccattgataacttaagcaagtttgacggaaccagggaagggatcgtgtacttgggccatggagcagggcttaaagggcataaattcctgttcgccacaaagcaggcccttgtaaagcaggtgcccggagaagaatttgaaaccaataacaggaccgtggctgccacaaagcttactgatgacgacatgctcttaaatgtccagcttgtaaacgggcagacagatgtggtgcttcagacgtcggcaggcgtatttttacgattccagacagaggaaatccctgagatgaaaaaaaatgcaagaggggtaagggggatcaagctggctcctggcgaagaactggaggcggtgcacttattaggtgaggatcccatcatcacttacaaggaaaaagaggtccacttaaaccggctgaaaattggaaaacgtgacggaaaaggcagcaaggtgcgcctttagtgctttacagcagcatacattttgatgaaatgtgttcgtaccgcgcacaaatgtatttttatggcgaataaatgttgatttttttttcactttgttataggatagttaagactttagcatatcatagattacaaaatgaaaagaaaagaggagaaagttatggaaaagaaattgcgagtcggtgttttaggagcaaccggtatggtgggacagagatttatttctcttctggagaatcacccctggtatgaggtggtaacagtggcggcaagcccccgttctgccggcaggacttatgaggaagcagtgggcgaccgttggaaaatgaccaccccaatgccggaatccgtaaaaaaattatctgttatgaatgtaaatgaagtggaagcggtcgctgccggtgttgattttgttttcagcgctgtagatatgacaaaggaagaaataaaggccattgaggaagcttatgcaaagaccgggacaccggtagtatccaataacagcgcccatcggtggactcctgatgttcccatggtggtgccggagatcaatccggaacattttgaggtcattgaggatcagaaaaagcgtttgggcactgaccggggattcattgtggtaaaacccaactgttccatccaaagctatgctcctgttttaacggcctggaaggaatttgaaccttatgaagtggtggctaccacctatcaggcaatttcaggagccggaaagacctttaaggactggccggagatggtagaaaacatcattccttatataggcggggaagaagaaaagagcgagcaggagccgcttcgcctctggggaaaggttgaaaacggagaaatcgtgaaggccagtgaaccggtcatcacctgccagtgtatccgggtgcccgtattaaatggacacacagcagctgtatttataaaattccgcaaaaaacctaccaaagaagaactaattgaccgcatagtgaattttaaaggcttaccccaggagctggagcttccaagtgctcctaagcagttcatccagtatctggaggaagataaccgtcctcaggtaacccttgatgtggattttgaaaaaggaatgggaatctccgtagggcgtttaagagaagattcggtttacgattataaatttgtgggtctgtcccacaacacggtccgcggtgcggccggcggtgcagttctctcagcagagcttttaaccgcaaagggatatatcaaggccaaggaatgattggattgtaaggctcccggcctgcaaggagggagctttcagtaaaaaggtatatggaggaaggaaaatggcatacaagaaagagctttggggaaacatgcccgatggaagagaagtgtatttgtatacactggtaaacagaaacggagtttccgcttcttttacgaatctgggtgcagtttgggttaccatgaacgtgcctgacaggaatggaacaatggttgatgtggtcttaggatttgacagtgcggaccagtatcttttaaacccgcctcactttggagcccccatcggaaggaacgccaaccgcattggaggagcgaaattcagcattaatggaaaagagtacaggctggaagcaaataatgggccgaacaatcttcacagcggtccggatctttaccagagccgcctttgggacagtgaggccgaggaaaacgatttgggcaccagcgtcagtttttcccttttttcgccggatggagatcagggatttccaggaaatgccaacattaccgtgacatatacccttactgctgatgacagccttgaaatttcctatcacatgatctgcgatgcagatacagtggcaaacttcaccaatcacagctatttcaacctggatggacaggatggctcaaatgtcatgaagcagcgcgtctggatcgatggggatgcctttaccaggaccgatgagggttccattcccaccggagaactgactcctgttaagggtactcccatggactttacggttatgaagcccattgggcaggatattaacgaagaatatgaggcgcttatttttggcaaaggctatgaccataactgggccttaaaccacccggatggagagatttccctatgtgccgcagcggaatccgatcagacaggcattcggatggaggtatatacagaccttcctggaatacagttttacacggctaacttcctggcagatggaatggccggcaagggcggagtcgtttatggaaagcgctgctgttattgctttgaaacccagtattatccggattctgtgaacaaaccggaattccagtccccggttttaaaggccggagaggaatataagacagtcactgtttacaaattttccaatatagaataaacaaaaagataatccagggacgcagggtgctgcgcccctgctcttatgtgaaaggacatcaggtgtacatatgaacaaactggacggaaaagggatcaaggcattgtctgttttgggtctgattataacaacgattatatggggcagtgcctttgtcgtgatgaagaattcggtggaagtgatcactcccgcctatctgctggctctgcgctttaccatcgcttccgctgctctggtggctgtattctggaaacgggtgagaaagatccgtaagaccgatgtgatgtgcggcgggcttttgggaatatttttgtttatcagttatttgtttcagacctatggtcttaaatataccactgccagtaaaaatgctttcatcaccacattgtatgtgatcctggtgcccttttttcattggttttacaataaaaagaggcctacggcaaacaatgtggcagctgcggtgatcgcagtattcggccttgcatttttatccctggaaggagacctttccgtgaatataggagatgtgatgactttggtatgcggctttttctttgcatttcacattgttttcattgaccgttatacagaagatcatgacccgattgttttgacagtgatccagatgatcgtggcagcaatactaagctgggcaatcgctttgccgttggaaggctcctttgattttcgcgtgatcggcccgtctatgatgaccggtctgctgtacctggggatattcagcacaatgctttgctttctcatgcagaatatggggcaaaagcatttaagtcctaatacttcttcgatcatattatcctttgaatccgtattcggattgatgttttccgtgatctttcttggggatcctgtgacgttaaaactgggagcaggatgtgtgctgatgtttgcttctgttatcctgtctgagtataaaaagaaagggacggcaatatcatagttgccggaaagaattgctattcgtgaattttagtggtataatagaacggttactatcataaggcggtagggagagatatgtcaaaatcgttatacattgcagaaaaaccaagtgtggcccaggagtttgccaatgctttaaaggctaacggaaggcgcagggatggatacatggaatcggaccaggtgatcataacctggtgcgtggggcatctggtaacgatgagctatccggaaagttatgatcccaagtacaagcggtggagcctttccaccctcccatttcttccaagggaattcaagtatgaggtgatcccaagcgctgaaaagcaatataagattgtgagcagtctgctgaaccgtcctgatgtggatacgatatatgtgtgcacggactccggacggaaggagagtacatataccgtctggtagcacagatggcaggagtcaaggacaagaagcagaagcgtgtgtggattgattcccagacagaggaagaaattttaagaggcatcagggaggcaaaggatgaatccgaatacgataatctttcagcatctgcctatttaagggcaaaagaagattatctcatgggaattaatttttcccgattgcttacactaaggtatggacagaacatttccaattacttaaagagcggaaaaaatacggtaatatccgttggccgcgtcatgacctgtgtcatggggatggttgttcggagagagcgggagatcagggagtttgtaaaaaccccgttttaccgggtgatcggaacctttttaagggaagatccggaccggcccgagctgtcgggaatggattttgacggggaatggagaagtgcccccggatctaagtattttgaatccccgttcctttataaggaaaacggctttaaggaacgaaaatatgcggaagagctgataaatgccctgtccctcatggaacccatggaagggaccgttgcttccatagaaaagaaaaaggaaacaaagaatccgcccctgctttacaatctggcggagcttcagaatgattgttccaggatgtttaagatcagccctgatgaaaccttaaagctggttcaggaactttatgaaaagaagctggtcacctatccaagaactgatgccagagttttatccacagcggtcgcgaaagagatccataagaacatcggcggacttaagggctttgagccattggcagaagcggcagcagaggtcatggaaaagggttcctaccggaccattgaaaaaaccaggtatgtcaatgataagcagataacggaccactatgccatcatacctaccggacaaggtattgctgcattaaaaggggcatctcctttgggaaccaaggtttatgaagtcatagcaagaagattcttaagcgttttttatccgccggctgtttatcagaaatatgctctggaactagtggcggatgcagcgtaccctgctttaaattccgccccgtctcttcaggaaccgtgtaaggaacatttttatgccaatttccgtgtcatgctggaagcgggctatttaaaaattgcagaggtatcttgggggaaaaagaaacagcaggaggaaggaagtggagaagccccccctgaggacggaagccaggaagagaataatccggaatcttctcagaatcagatggataatccggcattcgtcgccatgcttggaagtttaaaaaagggaatgaagcttccccttaagaaattgatcatcaaagaaggagaaacctcccctcccaaacgctatacctccggttccatgatcttagcaatggaaaatgccggacagcttatagagcatgaagagctccgcgcccagataaagggaagcgggatcgggaccagtgccaccagggctgaaatattaaaaaaactgtttcatattaaatatctttccctaaacactaagacccaggtgatcgttcccacacttttgggagaaatgatctttgatgtggttaatgcttctatcaggcagctccttaatccggaattgacggcaagctgggaaaaagggctgaattatgtggccgaggggaccataacccctgaagaatatatggtgaaactggagaactttgttgccgggcggactgcaggagttttaaggctcaacaatcattatgacctgcatagcatatttgacgctgcggcagctaattataaaaaacaaaaataggagattataaaatgaaaaaagaagatatgacaaaccaggacttatttgataccagccataccatagccaaattattatttgaacagaccacttacccatgggagatccttccgaaaatcagcgaatttattgtttccctgggagagcgtcttccaaaggatgagtttgttcatgtgggaaaagcggtatggatccataaatccatcaatcttccgccaacagcctgtatgggtgagaatgtgatcatctgcaagggagcacagatccgccattgtgcatttatcagaggcaatgccatcattggagagtttgctgtaattggaaactcttctgaaattaagaattccattctttttgacggcgtgcaggttcctcattataactatgtaggagattccatcttaggctataagtctcatatgggcgcttcttctctggcttccaacgtaaaatccgacaagtctctggttactgtccatgcagaagacggtgatattgagacaggacttaagaaattcggagccatcataggcgatttcgctgaagtaggctgcggagcagttttaaatcccggaacagtgatcggaccgaaatccaatatttatcctctttcctgtgtcagaggctgtgtagaagctaactccatctataagaaccagggagaaatcattgagaaaaatttgattgaggaataaggaacagtacaatggataaacaacacactgcggcaaagaacggaacctttggttcacggatcgggtttattcttgcctctgtcggctctgcggtaggtatgggaaacatctggatgtttccctaccgcctgggtcaatatggggagccgcttttttactggtgtattttggctttgttttttatttggcatggtcgggctttccggtgagtttgcctttggaaggctgaccgggacaggccccattggatcttatgactatgccatgaagaccaggggaagaagggaggagcctttcttggagcaattcctttgatcggctcttttggcattgccataggctatgccatcattgtaggctgggtcctgaaatatctgttcggttccctgaccggcgtaatgatgaactcggatacaacggaatacttttcaggcatgacgggaaaattcggcagtgtaccctggcattttcttgtggtggccattactgtggcagtgctggcaggaggcgttttaaagggcattgaaaaagtaaatgcaatcatgatgccgtccttttttatcctgtttgccatcattgcggtacgggtcttttttcttccgggagctttggcaggctatgaatatcttttggttcccagatgggaatacttgctgaaaccggaaacctgggtgatggccatgggccaggcattcttttccttatccattacgggttccgggatggtcatttacggaagctatttagataagaaggaagacattcccaaggcagccattaccactgcgtttttagatacaatcgccgcgcttttggctggttttgccatcattccggcagtctttgccttccagatggacccggccagcggtccgcctcttatgttcatcacagtacctaaggtcttttccatgattcctgcaggaagatgggtggcagtgctgtttttcctttctgtgctgtttgcaggagtgacttccctggtgaacatgcttgaggtatgctcggaggctgttcagacacatttgcacttttctcgaagaaaagctatctttttggtaggagctgctgtatttattccgggacttttcatagaatatgagccgtatatgggattctttatggatctgattactatatacgtggttccctttggcgctgttttatgcgctataataatttactgggttttaaaggacggcaggatcacggaagaattaaacagaggccgaaagaagcctttagggccggcttatctttttactgcaaaatatatttatgtttttcttgcggcactggtgtttgcacttagcattatatataaaggaatcggataagatataaatgaaagcgcgttttgaatcggctgtataagccggatcaaagcgcgctttttatgcaggttcaaagggtgttttctgacagcccctttgcagtctgctattttgtaccgaaaatcctgtcacctgcatcacccagtccaggacagatataggcgttttcatttaactggcggtccagatgtccgatgtagatctgaatgtccggatgtgcttccctaagtctttttaagccttcaggagcggcaataatggccatgaacttaatgtgctttccgccatgctgtttgatgaaatccacggcagcaactgcggaaccgccggtggccagcatgggatcggtcacaacaatggttctcagctcaataggacttggcagcttgcagtaatattcatgaggctcgtgggtgacttcatcccggtaaagaccgatgtggcctacttttgcggaaggaaccaaagccaggatgccgtttaccatacccagccctgcacgaaggatgggtaccacagccatttttttaccggagatcatgggagtcatgcaggtctcaatgggagtttccacctccacatcctgtaaggggagatctcttaaagcttcaaatcccatcagcattgcaatttcctcaatgagggcgcggaactcgttggtgcctgttttcttatctcttaaaatagagatcttgtgctgaatgagtgggtgggtaaaaatggttacgttgtccattgaaaagtccatagtaattttaatcctttctttcatctcttgctgtatcaggggttccggcaatgtgaggcttatgtggacaccggtcacggctgagggaacagacctgaaatgtttagtgtgatggagcctgcttcaacatgaaatcctcttagctggaaaacttagtgatccatttgaagccttggcaaaaaaatgggatattgattcatgacgggaaagcaatggcagaataatccatatggaatacatttgcagttcctgacatgatggataacaagcaatttgccgtaattcccatgagaatgggaaccggcataaaatagccctgggcaaaataaattccactctgtgctaaagtacgtttcctgggatcacggttccttccggccggataattgcggtgacaggggccagaaaatcgaaggaggaaccaggaaatacaggaaccttaaatttagtacagcagtggaatattaagatgccgacgcctgcaaaggataatgccggcgatggattgaactgtcagtaaggggaccagtacggtggcgccgaatatggcggacagatgctggatactgagcagataataccgggtggtcagttttgcattgttactcatttttctaccccatttctttttatttccgtcctattttatcaaagaaaggggaaaatggcaactatttttcctattttgtctcaggagtatatttaataagcgcaaaatctcctaaactgtgaggtacggggatggaaacgataatggtgccgtgatcctcatagctaaaggattccgggaaaacaggagtgttgtctgaagaagctgcttttgtggaaaaatctgcattttggaacattttcacatatgcttccagactggtttcaccaagtaaagggaataaagcttcctttagctcaggggaggcatcaaaaaactggcagtcctctgagcggatgtattcagccagccccttggggtccgcataatccgtgagccttatattctttgcctggttcatatccactgtgtttgtaaaaaacagatttaccggataagccgctccttctccataaaacagcccggtatataccacggtgatccgtttcctgtccacagaaattacctcagctgtaatggaaaggctgtccttttccggattgaccgggtatgcttttagtatttccagggcattgttttttaacagattgttgatcttttctttcttcgcctcatcctctaatccggagacagccggatattgtatggaagcttttccttcctcataggtatgaaggccagaagtgatggagccagcagaagtatccttgtttgcttcgctttccggtgctttattgtcagaggttccggtcttttcaggttccggtgcatttgtgccggaggacatggattctttagcagcagcggtagctgattggtctgttttcatataattcttgtttccgcatccgcttaagatcagggcgcagccgatgaaaagggctggaatgaatgagtttcgtttcatagaatggcctcccttcattttcagtgattttttacagtatatcacaaatattgcagttgtgccgggatttccctcgaattaagaaaattataggaaattattggaaaaggatgacgaagagcagagaaaaggccttggaaatctgaaacgattcaaatttccaaggccttgctccctgccaagggtgtagtgccggcagtgggacttgaacccacacgatgttgccatcaacggattttgagtccgcctcgtctgccattccgacatgccggcgctgcttacaacgttcattattttatcataggattttccatttggcaagtgtttttttgcgattattaaattgaaaataggcagaatatattgtatgatagacagaagatgtgtttaaggaggtgtctgggccatgacatgtaaggaaacagaacgtctggtcatgccatacatcaaggatgaactgacggacgaagagctgggggaatttctgaaacatatggaatcctgtccggattgccgtgaggaattggaaatatattttactgtggacgtaggaatcaggcagctggactccgaaacggggaactataatataaaaggggcgctggaagccgccatagaacagtccaggcaaaggcttcaggtcatacggtgtattaaaattgccaaatatgcggtgtctacagtaagtataatggcgctgatctttacggtccttctgcagtgccggatttggatgcagtggggcttactatgatgggaagagtacccggtaagtgcctgtatgcctgaaagtgagggcaggaagcaggaaacatcctggggtatatctttatgcccaaaaagcgaggcagaaaagaggaaagacccaatgggtatacctttatgcccagagaacatgggcaggaaagaggaaacaccctgcgggtatacctttatgcccagagaacatgggcaggaaagaggaaacatggatagaaaaaaagttatattgattgacggaagcagcatgatacagaacgctttttatggacttccttccaatggagcgaagggggttcaaagccttgtaatgaatctggtggaagggggagaagcggactttctggccgctgcctttgattccggagcagacagcagaggtaaaaagattcataaaaacaccggggtgaatgaagagcttttaaaacaggaagagcttttaaaggaggctcttctttccctggggcttcctgttcttaataaggaaggttatacttcttccgatattctggcgtcactggcaaaaagatgcaaggcagaagatggagaagtcaccctcctgtccggagatcggatgctcttacaggcagtggaagagcatgtgacacttaagcttccggctgtgggggaagagggcctggaatttaagccctattccatggagactgtccgggaggagttcggccttgaaccggaggatttaaaaggtgtttttgcgttggccggaacagggggaattggagaaaagactgcctgtcagctgataagagaatatcacagcattgaaaatatttataatgagatggaaaaaatagagtctcacaggatcagggaagcccttgccggaagtcaggaagaggtaaggaagaaggaagaacttgttaccctgcgaaaggattgcgatatccgtctggattacacaaaaactctggagcaggcggagatccagaagatcatagacatggattttgttcccgccgtttttccgggagaagaggaacccaccctggaatcaggctttcatgcggttacggatctttcagaggctgaagaaatattcttaaaatgcgtggagggctgccggcctggcatccagctggtggtcgaggacaagaccgtatcagccctgtctctttgcctcagtgaaacagaatgttactgcttcattcctcaggggcttctcaagccggaatatctggcggagaaaggggcggagatatgtaaaagggcaggcttgacagctgtccttcatttaaagagccagctgtccttcttaaggcttacgccggaaagcccggtgtttgatgccagtattgccggatatttgctggacccattaaaggattcttatgaatacaacgatctggcggcagattatctggacctttccattccttccagaacggagcttataggaaaaagctcctttaaacatgccttggaggaaaacagggaaaaagccgtttcctgtatctgttatatgtcctatgttgcactaaggagccagagcctgcttcatgaggaattgaaaaagtcgggcatggataagctgttttatgaaattgaaatgcctttgatctacagcctgtttcgtatggaagaagctgggatccgggtggaaagggaacgccttaaggaatatggggatcgtttaaaggtccgtattgcggagctggaacagaagatatatggggaaacaggagaaacctttaacatcaattcccccaagcagcttggagaggtactctttgatcatatgaaaattccgggaggaaagaggacaaaaaccggttattcaacggctgcggatgtattggaaaagctggcccctgactggcccgctgtcaatctgatcctggattacaggcagctgacaaaactaaattccacctatgcggatgggctggcagcctatatagggcctgatgagcggattcatgggacctttaaccagacgattacagccaccggaaggatcagcagcacggaacccaacctgcagaatattcccgtccgcgtggagctgggaagggagatcaggaaggttttcgtgcctcaggagggctgtgtgtttgttgatgcggattattctcagattgagctgagagtactggcccatatgtcaggagaccagcgtcttatcggtgcataccggcaggcagaggatatccatgctatcacggcttcccaggtgttccatgtcccccttcatgaggtgactcctcttcagagaaggaatgcaaaggccgtgaactttggcattgtatatggaatcagctcctttggtttaagtgaaggcttaagcatcaccagaaaagaggcttcagaatacattaacaagtattttgagacttatccgggagtaaagtcatttttagacggtctggtggctgaggccagggaacagggctatgcttccagcatgttcggcagacgccgcccggttcccgagctgaaatccaccaactttatgcagcgttcttttggagaacgggtagccatgaattctcccatccagggcactgcagcagatattatcaagatcgccatgatccgggtggacaatgccttgaaaaaacagggattgcggtccagaatcgttcttcaggttcacgatgaacttctcattgaagcgtaccgggatgaagtggaccaggtaaaggagcttctggtggaagagatgaagcatgcagcggaccttgcggtatcccttgaggtggaggctaatgtaggagattcctggttcgatgcaaagtaaaatccttgcagcagcctgcaagggattttacctcatgggcagccgccggatggacatccaggcatatcgggctggcccaatgcattcatagggataaagggttggtgacaggatgagagtgattggactgaccggaggtgttggagccggaaaaagcatggttctttctattttaaaggaagaatacggtgcggaagtaatcaaggcggatgaagtggcccgccagctgatggagccgggaatggaaggctatctggcgctgacggaagccctgggaaagggcttcctaaatcaggagggagccattgaccgcaaagccctggctgcacgcatttttcaggatgacagcgcaaggaaaattgtagatggaatcattcaccctatggtatggaaaaccataagtgataaaatttctgcttcccaagcagggcttattgtggtagaatttgcaattatgaatgaagaaatggatgacagctgggaagaaatgtggtatgtccgaacttcaaaggagaaccggatccgccgtttggcggaaagcaggggttatacaagagagcattcggaacgtatcatagcaagccaggcctctgaatcagagtttttaagccgttgtacgcgggtgattgaaaatgacggttccatggaagaggtgagaagccagctggctgaaatattgaaaaacaggggatagaaaatccctgcttatggctcagcagatgtgctgcgaaaggaaatacccaggggtatgcctttatgtttaaaaagcgtggacaggaaagaggaaatcatgagattggtaagtattgcaagcggaagcagcggaaactgcatttatgtgggctccgatactacacatgtcctggtggatgccgggatcagcaacaaacggatcgaacagggattgaatgagattggaataaagggtaatgagctgaccggaatcgtcattacccatgaacattccgaccatacgaaggggctgggagttctggccaggaagtatggagtccccatttacggaacaaaggagaccctggaagagatatcaaagcagaagtatctgggggaatatcccagggaactattttgcgccatcaggcctgacgtggatttttgtgtgggggatctggaagtaaagccgttctccattgatcacgacgcgtcaaacccggtagcttaccggatccagcacgggcgcaagtctgttgctgtggccacggatatgggacattacgaccagtacatcattgaacatcttcagggacttgatgcagtgcttttagagtccaaccacgatgtaaatatgctccaggcaggcccttatccctattatttaaagcgccggatcctgggagatcacggacacctttccaatgagaatgcagggcggctcttgtgctgtattctccatgataacttaaagaagattttgctgggccacttaagcaaggagaacaattatgaggaacttgcttatgagaccgtaaggcttgagattacagaaggtgataatccatttaaggcatcggatttttccatagcggttgcaaaaagggaccagatgtcggaaattattacaatatagcgagctgaactgtgggcttataaactaattgaagaggagaagtattatgaacaaaacgattattacagtagttggaaaagacaccgttgggatcattgcaaagatctgtacttatctggcaggcaacagggtgaacatattggatatttcccagactattgtccagggcttctttaatatgatgatgatcgtggatatcaatgacgcagcaaagcctttcggggagctggccgatgaactggaacagattggcgatgaaatcggcgtaaaggtaaaatgccagcgagaggaaatttttaccagtatgcaccgtatctaatgataaggtaaaggcttaagaaaaggatgggttcttgatatgctaaatatgtttgaagtaaatgagaccaataagatgattgaacaggaaatgcttgatgtgcgtaccattaccatgggcatcagcctccttgactgctgcgacggtgatttgaaggcaatgaatgaaaagatttataacaagatcacgactgctgcaaaaaaccttgtggaagtaggcagggagattgaaaaggattttggtatccccattgtaaataaaagaatttccgtgacccccattgccatagtcggcggagctgcctgcaaaagtccggaagatttcgtgaccattgcacagactcttgaccgtgcggccaaagaggtggatgtgaattttatcggcggatactcctctttggtaagcaagggaatgactgctgcggataaaaatctgatcctctccataccggaagcccttgcctgcacggaccgggtatgcagctccgtcaatgttggctccacaaaaacaggcattaacatggatgcagtggcccttatgggagagattgtggtggaaacggcaaaggctaccaaggataaggattcccttggctgtgccaagctggtggtattttgcaatgcaccggatgataatccctttatggcaggagcgttccacggggtaacggaagctgagacaatcattaatgtgggagtcagcggcccgggggttgttaagacggccattgaagcggccagaggaaaggattttggggttctgtgtgaaaccattaagaaaaccgcctttaagataacccgggtgggacagcttgtagcccaggaggcttcccgaaggctgaatgttccctttggaatcattgacttatcccttgcaccgacgcctgccgttggcgacagcgtggctgagatcctggaagagatcggactggaacgggttggcgcgccgggcaccacggcggctcttgccatgttaaatgaccaggtaaaaaaaggcggcgttatggcctcctcctatgtaggcggtttaagcggcgcgtttattcctgtcagcgaagatcagggaatgattgatgcggtggcaatgggagcactgaacatagagaagctggaggcaatgacctgcgtttgttccgtaggccttgacatgatcgcaattcccggggatacgcctgctaccaccattgcgggcattattgcagatgaatctgctatcggtatggtaaatcagaagaccactgccgtccggattatccctgtcattggaaagtctgtgggtgatacggtggaattcggcggacttttgggatatgctcctgttatgccggtcagccggtattcctgtgaaaaattcattaccagaggcggacggattccggccccgatccacagctttaaaaattaaaaggcagcagaggaaggattgggagatgaacatttatttgattcgccatggacggcaaaacagcaggctctgtaatattgatgtgaatttatcggaagaaggactccgccagtcggctctgatgggaaaacggcttgccgccaaaaccattgaagcggtgtattccagccatttgatccgggcggtggaaaccgcaaaagaggcaaaccgttactggaatgcagagcacatcataagacaggagcttagagaaatttccttcggggaaatggaaggcctggcggatgaggagattgaggcaaggtttaaggagtttaagaaagaacaggagcagatggaactggatttgccctatcccggcggtgagtgcgcaggggaggtcataaggcgggcaatgcctgtttttgaggaaatcaccgcaagcggcttccagaatgtggcggtggtgactcacgggggcctgatccgcatcgtgatcacggcactgcttcatatggatccgaaatattaccgtctccttggaaactctcttgaaaactgcagcatcacggaaatacactggaatgaaaaaacagggcgttttacagtggaacgatttaatgattttgcacatctggaaccatatccccagcttttgcgggcaagctgggtggagacagaaaactgaaacaccctgcgggtatacctgtatgtccaatgggcatgggcaagtaagaggaaacaccctgcgggtatacctgtatgtccaaagatcatggacaggaaagaggaaaggaattgccagatttcatggaagaaaaggaaagagaaaatctaattcagatcggaagggaatttctggatgaaaatctgcttcggatcgtagtcagcaatccggcggataagcagggcgtttccaaggtaaaggtacgcccgcttttgctaaaaggaagcctgatctttcaggcggaggagctggttgggaaccaggccttccataagaattattctgcagaggaatgcatgtcctatatagcggacttgctggatgggaagctgcgccagatggaactggattccgggaagggccaggtaagagttttggtgagtaaaaaagggaatctcagcatcaaggtgaagcggcagcagaagattgcagcgccttccccagttcttcagcataacagacagaagacctatattttaaaagaagggacaaccgttccgtttctggtggatttaggcgtcatgacggaggaagggaagatcattgcctcccggtatgataagttccggcagatcaaccggtttttggaatttattgaggatattcttccaaggcttgataagaacagggagaatgtgatcattgattttggatgcgggaaatcttatctgacttttgccatgtattactatcttcatgagttaaaagggtattctatccgcgtcattgggctggatttaaaacagacggtcattgatgactgcaaccgtttaggagaacggtatgggtatgataagctgaaattttatcatgggatattgcctcctatgaaggagtggatcatgtggacatggttgtaacacttcatgcctgcgataccgctacggattatgcccttgcaaaggcagttaagtggggagcttctgtcattttgtcggttccctgctgtcagcatgaactgaataagaccatggatcaagagcttatggctcctgtatttcaatatggcctcatccgggaacggatggcagcgctttataccgatgccctcagagcggaaattctggaaagccggggataccgcactcagatcctggaatttatcgatatggagcacactcccaagaatattctgatccgcgcagtaaagcagggcggaaagaaggacaaccgaaaggagataggggagatcctggaatttcttcatggaaaactgactcttgcaaacctgttgctggaagatgatacaaaatggaaagcagatggtaatttctgatgatatgtggtatgatataaaaaatactttaaggaggagctatcaatgccttttattaattccaaagtaaatgttacattatcagaagaagaaaaaacagccttaaaggccaggcttggacaggccatcagcctcattcccggcaagtcggaaagctggctcatggttggttttgaagataactgttctctttactttaagggtaagaatgatacaaagatggcttttgtggaagtgaagattttcggtcatgcatcagagcaggattatgaccgcctgactgctgagatctgcaagatccacaaggacgtgctttccattgcacaggataaaatttatgtgaagtatgaggaagtggatcactggggttggaacggcggaaacttttaactgcatcagatgattcttaggtcgggaggaatggcttatggagctttgggatgtttacgatgaaaacagagtggccaccggaaaaacccatgtcaggggtgtaccgctggcccagggggaataccatcttgtagcagatgtctggctggtaaatgaagatcaggaaattttgctgacaaagaggcatccggataagccctatggccttatgtgggaatgcaccggaggctctgctcttacgggggaaacaagtgtggagggagcccttcgggagctttcagaagaagttggaatacgggcggaaaaagatcagctctttctgatccataccatccgtcagaaagagcgttttgtagatacctatattaccaggcaaaaggtcaccataaaagatataaccattcagaaggaagaagtggtggatgcaaaatttgttacatttgagcagctccttgaaatgtggaaacaggggatcgtggttccaaaatcccggtttcttctatataaagacaggatccaggaattccttcagccgctgtcatagaatgacgacggaatgggtgaactcgtttttcatttttatgggatatttgtcctgcacaatggtctgataaatgtgggagcagtaaaaatcctgccggagcatggaccaggcaacgccggaaaggatgagcctggcatcggcggtttttgttatgagagggatgctccctctcttttttatttctcccataagggggcggatgtctttttaaagcctaaaacacgggcatatggagcatagccggcgttccggcccaaaacgacctgatgggaagtgatccccaaagcgatatggagaagggcccggctgatccgggtgtaagtatactgtcttgtttttaactggttgatccgttcttcaaagggaaggaaatctgtaagctgctttaaaagccttgacgccaattcctccgaaacatcggcatatttctgaaagggaatcccttcataatccaatttcagcaaggaggtatttaacagggcgctgaaatcatcaggaaacacagggaagccctgagacatcatctgctttacggcatcaggcacctgtatctgagaggaatcggcctgctccaggatatccgggttttcatgaagggctttccggatcccggtggcagaactgtaatgctctgaggccaggctggtatcgtgatagccgctgccttttctggaaagggtgacaggagtcatcgggcttttttgccggtaaagggccttgcaatattcgatcccaaggatgttgtttggggaagtcaggatggaggcctcctcctcttttagtattccgcaggaaatcaaagcctgattcctggcttccggaaaggtggccccctttttcagctccctgcgcagctccttcgtataaacagggggttcggtggctaaaatagaagcaataccggaaagtttttccacatctccgcattcgcttccaaaacagaaggcacccgtcactcccagattgttaaggagagcgactgcgcaggcggcaaagtcttctgcgctgctggaggcaaaaacagagggtatctcgatcacaaggtcggctccgcaggacaatgccatggctgtcctggtatatttatcatagatggcaggcgctcctctttggacaaaatctccgctcatgactacgatgcaatagtctgcctgtgtcatttccttagccttcctgatatggtaggcatgtccattgtggaaggggttgtattcggcgataatgccaacggcaagagaatgtttatttttcaccataagaaatgtcctttttctttttttatactctattatgctattgttccgcaaaaaatgcaaattattttagcacaagacttgaaaattttaacgaatacacatagaatagagtgagaatcaatgaaaaacattgattacaagaacaggagatcagataggtatgaattttatcgttgaaacatcagctcgtcatgtacatttatctcaggaacatcttgagattttatttggacagggctatgagttaacaaagaaaaaatatttatcccagccgggtcagtatgcatgtgaagagagagtaaccgttgtaggttccaagagtgagtttaaaggaatttccattttaggaccggttagaaaggcgactcagatagagctttctatgaccgatgcccgttccattggaattgccgcacctttgagagaatccggtgacgttgcaggcagcggtgcatgcaagattattggacctgccggtgaaattgaaataacagagggtgtaatcgttgcaaagcgtcatattcatgcaacccccgcagaagcagaacagcttggtgtgaaagatggtgaaatcgtttctgtaaaggttgacacgaacggaagaagcctgattttcggagatgtggttgtgcgtgtaaatgaaaattatgctttggctatgcacattgatacagatgaatctaacgcagcaggctgcggcagagaacagtacggtgaaattattaaataataaaggagaatcaaaggaatatgaaaattttagttattaactgcggaagttcttccttaaagtatcagctgattgatatggagaacgagggagttctggcaaaaggcttatgcgagagaatcggcattaacggttccaagctgtctcacaaggcagaaggaaaagaggaaatggaagtagagaaagagatgccgaaccataccgttgctatcaagctggttatggatgcattggttgatccggaatacggtgtaatcaaggataccagtgaaatttctgcagtaggacacagggttctccatgccggcacgatttacagcgattccatcgtagtaaatgaagatgtgaaaaaagttatccgtgactgctttgatttaggacctttgcataatcctgcaaacctggtaggaattgaggcatgtgaggaagcagtacctggagttcccaatgtagcggtatttgatacttcttttggtatgggtatgcctgaaaaagcctccatgtatgcaattcctcatgaatactatgagaaatacagcattcgccgttacggcttccatggtacaagccataaatttgtatccaatgaagcgttaagctattgcggtttagatcctgagaagggcaaggtagttgtttgccatttaggaaacggagccagcatttcagcctccatcggcggcaagtgtgtggacaccagcatgggactgactcctttagagggccttatcatgggaaccagaagcggtgatattgatcctgctgttgtacagtttatctgcaataaggaaggcaagagtgttaatgaagtattggatatcttaaataagaaatccggtattctcggcatgtccggaggcatttccagtgatttccgcgatgtgcagaaggctcagggagaaggcaaccatctggctgatgttgctattcaggcatttatttaccgcgtagcaaaatacatcggtgcttatgtggcagccatgaacggtgttgatgccattgtatttactgcaggtgtcggtgaaaacgataagccgatcagaggtgcggtttgcgaatatttaggttaccttggcattaccattgatccggagatcaataaggcaagaggaaaacgtgtcatgatttccacaccggattcaaaggtaaaggtatgtgtcattcctaccaatgaagaactggccattgcaagagagacaaaggctctggtataattcgggtgaaacggtacatgatgttgtatatgggataaaggtcgaaagaaaatccccttgattcattcgtattcaaatatggaaatatttgttgacaaatgttgcacccatatgtataataacataggtgcgtattaggagactagtatgcttattaatttaactgagttgtttaccctggaagggaaagagaaaacttatacacccgaacttgaaatgaaggtctatcatgggcccaatggcgattatgaagtggtggatgcagaacctgtgctgctgcggattatgaatctgggggacaagaggctggaagtggaaggaaaggcgaaactcgctttgcttattccatgcgaccgctgcttagagccggtgcgtgttgacttagattttgatgtgatccgtgctcttgatttaagtgaaacggatacggggatagtagaagattttgaagaacaaccatatgttaacggttataatctggatgtagaccagttggtttgtgatgaactcatactgaacctgcctatgaaggttctctgcagtgaagactgtaaggggatttgtaatagatgtggaacaaatctcaatcatgagacttgtgactgcgatattaggcctacagaccctagaatggcagtcatccaggatatttttaaacagtttaaggaggtgtaaccatgtctatttgtccaaagaacaaatcttctaaaggaagaagagacaaacgcagagcaaactggaaaatgagcgctccaaacttagtgaagtgcagtaagtgcggtgcacttatgatgcctcacagagtatgcaaggcttgcggttcttacaacaagaaagaaatcatttctgttgagtaatctatttgaaaaagaataagctgtaaaggctgataaaatcaaggctttcctataataagggaagtcttgttttttgcattgattgccttttggtcaaaaggcgaaaagaatcggttctcatcatcttgcatctaagtctgaaaatctgataaacagtcagaatcaataaaacacttccaaggataatctcataaaaataaataatcaaatcattcagtatgcacttgttgcatgagtcattgtgtaaaagaacaattacccagggatatttccaataaatgcataaacatagtccgtatgaattgacaaagaaatactgctggtctaaaatgacaacgtaggacaaaaggagaacggaaggaaggtggaggttattcagaaagcaaatatgatacagatagccgagcactgcggtgtgtccctaaagacggtatcgagagtgctcaatcacccggaacaggtaagcccaaaacgagagaggcagtcagacgttccatggagcagtgcgggtttcaggtgaaccttttggcaaagggcttaaagcagaacagaaccaacatcattatcgtgtttctggataagcacaatgatgcatatatgaatctgtggagaagcgagatgctgaaacatatctttcgctactccagtaagattggtctgaaggtaattgtatcgccgtcagattgctatggattccgggaggacgagacagatggattttaccttctatccagcgggattgctgatggagccattcttttggaatacatgataaaggatcagcggatcgaatatttaaagcgtacagctactccctatgtggtgctgggacagcccaaggagaaggatattccagctgtcagtctggataattttgatgtgggactgtctggcggcaaatatttgagggaaaagggctttcagaacatctgctatctgaccaatgacgagaacttctattccacagagctgcgtgtaaacggctttttaaaggcagtaccggatggacaagtgatctacggtgtgaaagatgccagaagcgcttatgaaaagacaaaggagctgttagctgacgggaagacggactgtatcttcacaaacggtgacaaccgcttcctgggaatttatagggcggcattcgaaagcggaaaaaagatacctgaggatttgggggtgctgtcagccgataacttgtccatcaacgaggaggcttacccggccctgtcatctttaggccaggactttgaaaggctggcaaaagaatgcatcagcctgcttcagctgcttctccaaaaagatcagaacaatgaagaactaaaaaagacacagatgtttctgccatccacgattattgaacgggagtccacccgatgaggcaaatgcagggataataaatcagccggaggaaatcatgaaaaagttagttgcaacagcacccagagtggccgaattaaaggactatgaggatcggcccattgaaagcaatgaggtgagagtcaaggttgaatttgcagctccgaagcacgggacggagctggccgatttcagaggaaccaccccttttatcgacggaaagtttgacagtgactggaatatttttacccagcgggagaaggaggaaccgcggggcatcgaattcggagatcttcccattggcaacatgtttgtgggaaccatcattgagaccggagcagatgtgacggattatgcagcaggagaccgggtatgttcctatggtccgatccgggagaccgagattgtcaatggagtaaataattataagctgagaaaaatgagaagggatgcctcggaaaaaaacgcagtctgttacgatccggcacagtttgccctgggtgggatccgggatgccaatatccgccccggtgataatgtagtggtgattggccttggagctattggccagatcgcggttcagctggcgaaaaagctgggggcggccgtggtcattgctgttgatcccattgaaaagagacgggaaattgcagcgcgctatggagccgatgtctgccttgacccgatggcatgtgacgtaggctatgaaattaagcgctccaccggaaagctgggagcggatgggattttggagacaagcggaagcgtgcaggcgctgcagtctgcgctgaagggcctggcttatggaggaacgatcgcctatgtagcgtttgcaaaaccatttccagccggtttgtggctgggacaggaggctcattataattatggaaaagtcattttttccagagcctgcagtgaaccgaacccggattatcccaggtggaaccggaagcggatcgaggatgtagtatgggatatgctcatgagcagttatctggactgttctgaaatcattgatcccattgtgaagtttgagaattgtgcggaaggcatttgtacctatatggatcgggaaccggaaaagagcatcaaaatgggcgttgtattcggaggtgaggcgtgatgttgctgggaacacaggagcgggatttttttccgaaggatctgacagagaaattcaagtttatgaaggccattggatttgagtgctttgaggtggatggaaaagtcctcatggaacaggctgaggaaataaaacgcgccattgatgtctcgggacttccggtatccagcgcatgcggcggttaccgcggctggatcggtgattttattgaagagagaagactgaacggcatcgatgatttaaaggtgattatccgcaatttaaaggaagtgggaggaaccggagttgtagtgccggctgcctggggaatgtttacataccgccttccgccaatggtttccccaagaagcaaagaaggagaccggaaagcaattctggattctttgaggcagcttgacgagacggctgatacatatggaataaacatctgcctggagccgctgaaccgttatcaggatcatatgctcaataccacagaagacgcggtttccatcattgatgagggaaaatttaaaatggtaaaagttacggcagacttttatcatatggcgattgaggaggacgatatctctgaaacgctggagaaatataaagattacatcggccatgttcatattgccgaaaatcacagatatcagccgggcagcggcagcattgattttaaacggcacatggagacattaaagcgaatgggttatgagggtgcggttgtcaatgaggggagaatacggggcgaagatccgcttaaggcttatgagaattccatcgcttatatgaaacagttcatatagaaacaggagggactcatgaacaatttaagggtggcaataatcggagccgggcaggttgcccggacttctcatatcaaatattatcaggacatggacggagtggcggttgatgctgtctgtgatatcaatgggaaagctgccgaggatacggcaaaggactttggaattccccgatggtacagcgatgttttcctcatgcttaaggaagcagagccggatgcggtcagcatctgcgtgcccaataaatttcactgtgatatgacctgtactgccttggagcatggctgtcatgttctctgtgaaaagccgccggcaataacggtaaaggaggctgaacagatgagggatacggcaaagcgatggggaaaagttctgacctttggattccactttcgttatgccgaacggattgcatttctgaagaaacagatcgaaaacggggagctgggtgccatttatgccggggacgtaacctggatgcgccggagggggatcccgggctgggggaattttactgataaagagcttcagggcggcgggccgttgattgacattggagtgcatattctggatctggcggtttatctcatgaactatccgcttattgactatgtctgcgccacggcttccgacaggatcggcaaaaggggagggacgggcttcctgggaaattgggacaaagagcggttcggtgtggaggacggattatttggtttcattaaatttgccgacggcagttccttaaatatcagaacctcttatgcagttaatattggggaaaaggagaaacgaacgctctgtctgtatggtgataaaaagggcctcagtgtatttcctgcggagctgtacggggaagaagacggatggcaggaaaaccggacatacccctttgatgagctgcgggactggcattatgactgcgtcaggcatttcgtggaatgctgccgggaggaggctgttagtctggtgacaccggatcaggccgtctatgttcagaaactgattgccggtctgtatcgttcggcagagaccggaaaaccggttgtatatggggctggaaacgttgatctaatatagaattgaaaatctgtttgatgtgattgtggacgggctttccataaccagggcaaagcctgatccggaagtatttctgactgcggcagagcggttttccgttgatcctggaacatacgggtctgcttctggaaacagaatataaatcattcttttgaagtcctggaaagtgggagatcatatgtaccagaattacttaaatacagaaaatgcgcaaaaaattgcagatgggatcatgaagatcattccctgcaacatcaacataatggatacaaacggggtgatcctggcaagcggcgacaaaagaaagcttggaacccttcatcaggggtctttgacggccttaaagcggaaggagtcttacgtggtgtatgagacaacttccacggagcaaaagggtatcagtctgccgatcatctataacaacagtattcttggcgtgattgctattaacggagaggtggaggaagtgatgccaatcggccagatctgcctttcaattgcggttttgatgatagaaaaccggctgttaagtgatatgacggcgatcaaggaaaaccgtctgaaggattttctttacgagtggattggcctgggacaggaagaatataacgatgctttttatgatcaggccgcctacttagggattaatctgaagattcccaggaccgcggtgatcataaccagcggccacatccgttacagcatcatcgacatcataaagaaccgtctgagtacggatgaatatattgtccgtcagggcatggacgaggtgctgctcctctttcaatcaggagaacggcttaaggcaaggctggaaaagattatggaggtcagcggtgacttagagcactgttatatcggggaatccaacatcgttgcaagcagggctaccagttccgtgatgcagacgtttcacattgccagtgcgctgaagatcaggaaacggattctgtgttaccatgaggtggcattggaatgcctcttaaataacatcgagatgaccagggaactggatgaaatcattcatttgctggaagcgcaggatgtggatggggtgctgagggagaccatatcagcttatgtggaacataatgacaattattctcagatatgcgaaaagctccacatccaccgcaataccctcaattaccggctggccaaaatcgaagagctgttaaacaaaaaccccaggcgggcaaaggagctgattctgctttacatcgccaccatcaagatgagcagccgatgaaagccgtgttgcgggctgtgcaaatgaacaatgataaagtgggagtttggtctcgtccacattgtagcggaggaggcttaatgataaaatactataaacatataagtaaagactaactattaaaagtcaagtctaaaaaagaaagtttatgaatgaattgcagaaatgcatttcaagtaaatcagtaccttgaaaaccgcatgacaaacagagcatctttacaggtgctcaaaaagaaaattattaaacagaaaagttaagagactttgttgtatgcctgtcccgatttttctaaccgataaatgactctgaccagcttcttcgcagcatgagaaacagcaacgttataatgcttaccctccgccctcttttttgcaagataggcggcaaataccggatcccacttacagacaaatttagcagcattaaaaagtgcgtagcgcagatacctggaaccacgcttttccatatgtgaatgagaagattccaactgtccggattggtaggtagagggagataatccagcataggcaagaatcttatcaggagagtcaaaacgggaaaaatcaccgatttcagctagaatcatggcgcccatccggtaactgattccaggaatcgtaagaataggggaatggagttcatccatgatacgttttatttcctgttcgatttcatcaatttcggcatctaattcacctatcagctttagggtgtgtttcagttccagagattttacaggcatattcgaaccgatagaggctctggctgtttccctgaacaggatggcgttgtctctgccgtaacgacccttagaggtttcgtaaagcagattggtcagtctggtaagatgagcagaagcaatctgaaaagcaccggggaattcgcttagtaaagcggaaatggaaggcatatgaagagtgggaaccagcttttccagttcaggaaaaagaatcgtaaccagacgggaaacagaagttttaagcttggcgcgctccctgactttatcaaaacggtaacgggttagtgactttaattcctcgttgtggtaagatatgtctgagtaggactttaagttcacatcagacataagcattgtagcaatcgtatgggaatcaactttatccgttttcgtctttctaaggcttagactttttctgaaaagactggtatgtaacggattgataacaaaggtggtcagacctttatcaagaagaaagcccaagatgttataactgtagtgtccagtggcttcaaggcctacttttacattggttaaatcatctgtagtggaagtgatcttctgatagaggacctcaaaaccttcccggttgttgggaatggtaaaggatttaaagagaatcttcccatctgagttggtgataaaacaatcatgcttatccttggaaacatcaatccctgcgtatatcatagcgaaactcctattaaatgaatttgatactgttttagaccacggtggctctctgcgattgtaaccttgttctaaataaaccgtcatgcggtatctaactgattaacaagtgaacaaagagactgtggttagagcctttactaaaccatcaagtggtaggagaaatgaactaatccacagtatctaaaacagcatagctcatacctaagaaaaggtaaagaaaagctatgactatataatacaaggagagggaatcatgaaaaaaagtttatcaaagaaactgacagtactggggcttttgatggtgaccgcagcaggtgcggcggggtgttcatcaaaaccggctgagacgaaagctgttgaaacaaaggctgaagagactgtggctccggcaggggaaagtaccagtgccggtggggaaaaggcctcaggcggggatgttttaaaggttacatacagcggcacaccggaaatccatgaaaaacagtatctgatggattcattctttaaaaaatttgaggaagaaaataattgtaaagtagaagttgattttgtagcacaggccgatgcgatcaagaaggttcaatcggagcaggaaggaaagaactacatcactgatattatttatgcggacacagccaatatggcaccctatgtcaacggcggctggatgcagaatatcacggatctggtcaacagcaccggctctacttatacacagatgtttgataattctacaaataaggatggaatacgttactttgtccccatgagttttgacgtatacgttacctgcgcaaacaaaaaggccctggattatttaccggaaggactgaccgaggaagatgttgtttccggtattacctgggaacagtatgctgaatgggcagtggcaatcgcggcaggcgaaggggaaggcaaaaccatgatgccggccaacttaaccggttcccagctgctttaccccatgggcggcatgagcctggcttatggcggcggattcccggaattcacatctgatggttttaaggacgctctcggcatcattgcatcaatcgctgcaggtaacggcttctatgcggagcaggatcagtatacggctcccactgacccgttgaacagcggcgacgtatggctgacatttgctcatatggctccggtgggcgcaagctacaatgcggctcccaacaactacgtaattggtgcggctcccaaaggcagcaagggcgcaggctcgacttccggtgcatggtgctatgggattgcccagggggctccgaaccaggaactggctgagaagtttatcaactatatcgctgatccggaagtaaactatgatttctgttccaactacggcggttctttaagcccaattgaagaggtgggtgatattctgggctcagatgacgttgtcatgagagctggtatcgaaatgttgaaaacaacgattgttaccggtgtgccggcatctgagtattccgattggaacgcagtgaagctgctttatggagatgtgtttaacagcgttttaaagaacaaggcagttcccggggaggatttccttgcagatgttcagagcaagatggaggcattaaagaactgatgaactaatcgtgtaaaagcctggaaggatgcaatgcggaccaggcgccgctgcatacttccaggctttaaatttaccggaattgctttctgtaaatttaagacgctccgcgggagacgtactttgcactgcagacttatatatagaaacgggggatttatttgaacgaaaatgtcagcaaacagattttggaaaaacccatgctcagcaaaaaaagtattccctactttctcctgttgccggccttccttttttatgcagtattctggctgctgccggtactttccggtataaaagaagtgtttaccgattttgacggcaactttacacttctgggcaattttaagctgatggcagagtctgatttgatcagcgctgcaatttttaacactgccgcatttgcagcggtatccgtgatccttcaatattttctggcccttcttctggcagtgctgctgtcgagaaagtttaaaggtgccaagatcctgatgttcgtttccatgattccaatggccatcacacctacggcggtggcgattctctggaagaccggacttgtgagggacggctggatcaacacggttttaatggggctgcatctgatagagaagccgattgtatttatgggtgcagaaggactgtccgcagtttttttaatcattctcatcgatacctggacagttacaccgtccgtcatgatcatcctgattgccggcctgcagggaatgcagcgggagctgaaagaggcagcctatctgttcggcgccaacaaatggcagatttttaaggatattgttatcccgattttaaaaccttcgatcacaacatccattattatgaggctgattgcagctatccaggtctgggctattgctgtgatggttctgggttacagcaaagtgccgtttttggtggagcgtgttgctttttatgtggaggcggtacctggggtcagcacaagccaaaagcttgcctttaccctgtccttcctgacaaccattatcgtcctgtgtgcaaccgtggtctatcttaaggtttccaggggcggaaagaaggaggcggcgaaataatggataaactgaatattgtacagaaaaccgttatggcaatcatcttggcaaccatgtttctgctggtggcaattccgcttctggctttcacaacggttgcattctccaacgctgcggaaatgacggagtttcccaaagggctgcttccgaagtttaaggtcacagtcaaagtggaggcaaacccgaaagaagagtttgagatcttctatgacagtggggaaggttatgaatcgattatcaccacgaaaagaccgtccaagctggagtctcatttcaccagacagtacgcggtgactgttcccggcgagcagcttatggaggatttcagtcagaccctgacggatgggcccatggaatttacctataaaaaagatttgttttacaattttaaaacctttttcagcattgtgcccaatgctgcttcagcgcttaaaaacagcatgatagtttccctttatacgattctgatttcccttggagtcggaagcctggcagggtttgccatggcccggttccagtttaaattcaaggagcagatcaatgtttcactcctcattgtgagaatgtttccggtggttgggatcagcatcccaatggccatgctgctgatcagattcgggctctttgatacgaggatcggcctggcgctgttgtattcggttcccaatattgcactgacggcctggattaccaacagcatttttatcggcatcagcaaagagctggaggaggcgtcgatgatctttggggcgggcagtgtacagacctttgtcaggatcaccctgcccctggcatttccggcactggctgccagttccatgtattcatttttgactgcctggaatgataccatctcggcattgattctgaccaataaaaatcagacgctgtccctggttgtctacaaggcaatcggcacaacgtcaagcggcatccagtatgcggcagctggaagtatcgtgctgattcttcctgcactggtatttacctttattatcagaagatacatcggacagatgtggggcggagtcgaattataggaggaagctatatgagctatttggagattaaaaatttacagaagagatatacaaaagatggtcctctgattgtcaacaacatgaatttgctgatcgagaagggcgagtttattgtctttctgggcccgtcaggctgcggcaagaccactacaatccggatgatctcagggcttgaagatatcagcggcggcgaaatactgattgatggggagagcattgttggaaagaagccgaaggaccggggcgtttcaatgattttccagagctacgccatctggccccatatgacagtgtttgacaatattgcctatcccttaaagcttcagaaggtgccgaaagaggaaatcaaagagcgggtgaccacggcggccagggcaaccgatattgagggcttactggatcgctatccggcacagatgtccggcggacagagacagcgggtggccgtatccagggcgattgttgtgaagccgaagattttcctgatggatgaacctctctctaacctggacgcaaagctccgggtatccatgagaacagagctgaaaaacattcacctccagcagaactccaccagtattttcgtgacccacgatcagtctgaggcgatgagccttgctgaccggattgtggttatgtacaaaggtaacatcgagcagatcggaaccccgatggaggtttatcaaaacagtgccacaaaattcgtggcagagtttatcggaaccccgccgaccaacttttttaagacaaagatacagaaagcagaagacgggctggtggcggcaaatgaacatatctgctatcaggtgccggacgctcttgtacaggcgcttttaccctacgccggaaaagaagttcatatgggtgtcaggccggaatatatcgatttatcgttttcactggaaaaaacaccgggatatatgtgtgatgccacgatagattttgtggagccgcagggatcccatgccattttgattacaaagataggcggcaatgaagtgaaaattcataccacggcctatatggagatggcacctaagacaaaggtggcgctgcaggtgaaagaagaacgggtcatgttctttgactgtcagacaacactgcgcatcagataattagatttggagataaaatatggacagcataaaagaacatttacaacatttatatccggattgccacgaggaactggcagaacggatccatggattgatagaaacctggaaaccgaagatcaaggagtcatatccctgggtagacaaaggcgatatcatgttgattacatacggcgacgggattaagcggaagggggaagcacctctggccactctgcgggcatttctgaaggaagagcttgcccgtacggtttctgcagttcatttactgccgatgtttccctatacttcagatgacggcttttctgttgtggatttcagggagatcaaccgggaactgggagactggtctcatatcgaaaagcttcgtgaatcctatgacatgatgtacgacgcggtcatcaatcatgtgtcaaagtccagtaagtattttaaagaatatgcggcgggtaaccctaaatacagaaatttctttattgaggcggatccggcaggggattacagctcggtcatccggccgcgggcactgccgctcctgacagaattcgagaccggttcgggcaaaagatatctctggaccaccttcagcgaggatcagctggatttgaattataaggatcctgaggtggtgttggaagttctggacattctcctgctttatgcggcaaagggagccaggtttatccgcttcgatgccatcggatttgcgtggaaggagctggggacaacctgtatgcatctgccccagacccatgagctgataaaactcatgaggtgcgtgctggaggcttgtgtcagcggctgtactatcattacggagacgaatgtaccacatagagaaaacatcagttattttggcaacggctacgatgaagccggtctggtctatcagtttccgctgccgcctctgacgctctattcttacttaagcggaacagccgtctatctgtcggactgggcggccggtctggaaccgactaccgaagcaacgacatactttaatttcctggcctcccatgacggcatcgggatgcggccggtggaggatatcctcagtgagagagaacgccggttcatggttgagcaggtgctggcccggggaggtgaagtgggataccgatcgctgtccgacggaagccaggtcccctatgaattgaatatcaattacttagatgcggttgccggaaatgagacggatcccgttctgatggtccggaaattcctgggctcccagtgcatcctgctgtctttgatggggatgccggcgatctattaccacagtcttttaggttccaggaactgttataaagattatcaggagtcgggcatcaaacggcgtatcaatcgtgaaaagctggatgcagaccggctgagggaagaactttcccacccggattccataagaagcagagtgctttccggttaccggaagatgctggctgtaagaaaacaggaggaggcctttgcgccgaacaatttacagcaggtccgccggctgcatgacaaggtctttgccgtggtgagaggagcagcggggaaccagatattggcgattgtcaacgtatccggggatcaggtggaagtaaaaaccggactggacggaaccgatctgctttccggtaaaatcatgaaacagaatgtttcattggaaccatatgaatatctgtggttcaaaataaacggctgaacggcataaataaggagagtgcagttatggacagagattacagttttttagattctcttgacaggggaatgtattttgagaaaaaagaatatgacggagttccctatctgaaatacgacgaagtaaaagacttacttccggcaccaattgtaacgaatcatcaggagtgggtggattgctatcattatgcggttcgtatcctgtataccaatattcatcagcctgctgagggcagtggttttgtgagcaattttgtggatgcggcttttaataatgatatttttttatgggacaccgtcttcatgacactgttctgcaatctgctccacccttttgtgccgggaatctgttccctggacaatttttattgcaagcagtttgatgacggagagatccccagggagatggtacgggataccggcaaggattttctgctgtgggtcaatgccttcgacagcccgctgtactcttattttcacaaccattatggttttcgtatgctcaaagaactggggacgctggcctatgaggatatgtataaaccgaatatggggcgtattatcgaaaagaagccttatctgactctggataatttaaatcatccgctgctggcttttgcggaatgggagagctattgccataccaaagacgtgaaacgtctccgcatggtgctggaaccactgtaccgttattatgaagcactgaaataccatctccgccatcaaaatggtctgtacgtgaccgattgggccagcatggacaattcaacgaggaataagcatctgggcctggcagtggataccagctcggagatggtgatgtttgccggcaacctgactgacataatggatgagctggtaaaatacggctatgatgtgccggattatgagaaacggcgcgaagaacttgtcagagacaaagccatcctgattgaaaaaatcaaccgttatatgtggaatgagcatgagggcttttattatgacattacctttggtgagcgccagaccagaatcaagacgatcgccggattttttcccttggtgtcaggtgttgccgatgagaagcaggggaaacgcctgattgaatggctggaggataaagaagcatttaaccgcccccaccggattccggtgctggctgccgatgaagagggatatgacccacggggcggctattggcgaggttccgtatgggcgccgaccaacgccctggtgctccgcggcctggagaatcatggttttcataaactggccagagatattgccgtcaatcacctggatgttatttccaaggtatatgagcagacaggaacgatctgggaaaattatccggctgatgagatttccagcggtgattctgacaaaaatgagtttgtcggctggtctggtctgggtccgattctctgcctgatccagtatgccgtgggtctgtcactggagcgcaaagaaggcgagccgacggtccgctgggagatttcagggaatcttattaagggcggtatgctgggctgtaagaagtactggtttgcaggaaagacggcggactttgaggcaaaggacatgggagggtctcttgatgtgaccattcacacggaggactgctttaaactgaacttaatttaccagggggcacagcattccatctccgtgcagggagatatgaagctgacattttaaccgaatcaagcaggggcgcggattgcgaatatccgcttgacgggaagtaaacacccttaggcagagggaaaaccatgtgtccggcaaaacctatacaaagaggtgctgctgaagttcctggccggctgccgggcacggaccggagaaaaggagatgtataatgaaaaagctggtaatatacggcgacagtatttcaacggttaaccacggccagggcggctatgaggcgttgattaaggaagctctctgtgtggcagagatctgcaatttttcggttggttccagcggtttgacaaaagccacaccagggaacatgctggaagtcctggaacaacatccgattccaaaagacgcagaactgtttttggtctggcatggaagcaatgactggtattgggggagttccctggaggaattttctgcagctgtccggattgcatctgataagctgcgagccgcagcaccggcggctctgctggcctgggtaacccccatataccgttttcagcggccggacggtgtgacgcaggaaggggaggcgtatgatcttcccaataaaaaaggatacatgatgctggactattatgaggagctggagcgttccagcaaaaaactgggatttttactgatagatatgcgccggctttgcggaattcaccgcaataacgcggagttgtatctggaggaccgggttcaccccaatcacgagggatatgtgagaatagcggcggtaatgagcaatgagatcaggaggattctgttatgaaacaggattgtgtccgggcggatgactttattgcggataagcggcatgccgtccgggggttaagagaggctgtcagatgtgctgtgaaaacaggctgcttatgtgtctgcctgggaaggggaacttatatactcgacgagtatgagacgattgagaccaattccattgcccatgacgatggctgcggagacatccgggagaaagactgttttctttttctttcaggaattcaggggctgacaatcagaggaacatgcacaaaggctggagaaccggcaactgttttggcaggactgcatgagcaggatccccagatactgatgccggctattttatgggcagaaagctgcagcagcctgaagcttgagaacattgccgtgaccagaattccggaaacggccagtgccggtgtggtgaagcgggtctcaaaagatgaggtggaggtggaggttttcccggatctgccctgtgaggatggaatggtcccatactgtatgaaccgttttgataccgggggcaatgaccgggggaataggaaggaatgccgtctgatgggggagagtcttacctatggatttggttatgaccgtcggtttatcaaaacaggggaaagaaccatgtgccttccggacgcaaagatcgcgggaaaggtaaaggttggggagggattatcctggcatcagtcagggcgcacggatttccagctttttttcggcggctgcgacggtttgagcctgtccaatatgcgtatttacaatacaaacgggtttgccattctgacggagaactgccggaatataacggccaggcgtctggttataaaaccggccggcgaccagttttttaccggacccagggatggctggaagatctaccgctgcggcggagcgatattgctggaccggtgtcatgtggaaggcgtacggatggacggtcagaacgtgcacagtaattttcttattgtggaaaggcggattggcaggcgagaactcatctgtacctgcaaatatgcacctgttccgctgcgtttgccttctgccatagggatctatgacggcatctccatgtctgagttccagcttgaaagctgggagtttgccggcggttttaaggagcgcagcgtacagccggaggaaaagactgccggtgccgctgtagcggggacggtcaaccagataacaagatatcgtctggtggtaaaggaggatctgcctgattctgcggcggcaggttccctggtgcatgcactgtgctgggaacctgattcctatgagtgcagggacagcgtgtttaaaaatattgccggtgcgggccatctgcttcgatgcagaaatgtaactattcggggctgccgctatgaaaaccttatgaatgccgggattttgatcggtgctgaattcagcacacactgcgaaggcgggcacggagagaatataacgatccaggattgcagctttatcaactgcgggttcaagccccggtatggctcttacggcatgggcggaattgctgtgaaatcccaaggcttttccggtccgtacaaccgcaatatcatcatttcaggttgcaggttcgaagcttgccgccaggggattgagctttgtgatgcgggtcaggttgttatgtcggatttgtgttttgtggatgtgcagcagccacttaggatagaagggaaaacgactgaaaaagtcgaggcagataatatccttgattcttctcaaatcgaggtaaaatatttatagaacaaatagatagaaaactctatgtgttcatgctataataaaacaaatataaatttgaacgaatcaaagtgaggataagtcaatgcctacgatcaaggatatagctgcaaaagccggtgtctcccatggcaccgtttccaatgtgctgaacaagagaggaaacgttagtgctgaaaaaattcaattagtggaacggatagccaatgagatggggtataagatgaacgtccaggcacagcagctgcgtgccggtatggcgcgcagagtctgcatcattgtacctaaaatcactttgaagtgctataatgacttatattttggtttagaacagtatttacgggatcatgatttcagcatagaattaatttgtaccaataatctggaatgcggtgaggaacgggcagtaaaaaaggctctttctttaaatcccatggctgtggtggtggtcagttccctgttaaagaaccgggggctgtatacgtcagaagcaaattttttctttgtggaacggaaggtaaagggaatgccggaaggtgctgtttacgtttcgtttgcatttgataaggcaggacaagatattgccatgaggtgcattgcagacggtcatagaaatgtggcattattctgtgaaaacagtatttattccaacagcaagagttttataaacggagcggtggatgtatttgaggataacaactgctattataaaatatttccaagtgatgacagcaaatggtttaataaggcgtttgacattttaaactcccaggaggaatttgatgcggtcattgcaatgagccgggaagatgcggattatgtaaaggcagcccaccaatataatccggataaaaagatgccggttatttatgctctcacaagtaaaagcattggcattgatcctgaagtgtgcaaatatgagttgaattataagctgctgggaaggattattgcgaaacgaattgttggaatcagcgaagaagaacgggaattaagtcagcctgaaaaggcaaaggagcaagggaagagccggatggaacaggttcttgtggaaaatgacgggttttatcaggaggctcctttttgcagtaaggacagttccctctgttttctgactatccagaatcccaccagtaaagccattaagatgcttcttccttcctttaccaaggaaactggaattaaagtaaatatgatagaggtttcttatgatgaacattataagatgtcccgtgcatgcagtcagagcaatccttacgatttgattcggattgatatggcgtggatgacagaattgggagataagatataccgtcctttggatgatgccagaccggtggtaagatggctgagagagcagattttgcctacattatctgataattattccatagtaaatggtattcggtatgcgtttccgctggacgcctgtgtgcagatgttgttttaccggaaagatttgtttgaggatgagctgattaaacgggagttttttgaaacgtataaaaggcgtctggagattcccaagacctttaaagagtataatgaagtggcaagattttttacgaaaaaggaaaatccggcttccagaaccagatatggagcgtcagctacttatggtcggacgtttcttgctgcctgtgatttcctgccaaggtttagggaatttaagaaggatatctttgatgcagacgggcatgtgaatatcatgattcctgaaatgaagcaggcgatattaaattacctggacacctgccgctataccagcaatgacatttaccagtggtggcaggaaccaacgcggcaattttcagaaggaagcactgccatgcacattgtattttccaattatgcttctgagatgattcacaatttggattccaaggtagtgggaagaattgcctatgggacggtccctggcggacagcctctgtcaggaggcggttctgtcggtgtttctaaattcagtaataagtatgaagagtgcatgatgttcttaaagtggctgtaccgaaaagacattgccgaaaccattacctatcttggcggttatgtatgtaatcatgaaatcagcaggaatatggacatactggagctttatccctggctggaggatatggagaaatcctttgaacctggctggagaatatcccatcacgacaaaaaccatgtttttaatgaattcctgtttgaagatattctgggaaaagcggtccgttctattgcttcgggcattgaggaagcagatattgccctggaaaaagcacaggcagaatgcagcaaaacttttaaccctgtaccaaacgttcttaaataatataaaattcagaaaaggtgttgcagcaggagtttcagtaaccgattgccggttaaactctgctgcagcacctttttgttgtgttaattggagaagaaagttgtgaataataattgaacgtgtcaataaaaatgaagaaaaaacatgtgaaaatgcgagtggcacatcataatgtgcacaaaaaaatgtaaaattcttgataaaatcatgtaaaataaacaattaaatcagaaaatgatattgacacgttccaattaatggtgtataaaatagataaagaaccaaggaggtaaggatcatgtacacaaagaatcaaccaattaaaaatcttatcgggagaaataagattttaattgcggcgcatcgtggaacctgcgggggaaatgtggtccagaatacatgcatgtcatataagaatgcattgcttcatggagcagatatgatcgaggtggatgtttccatgacatctgacggagtgttttatgcgtttcataatggggaagaaccgttggaacttggggttgaccgggatatcagaacgatgacttcaaaggaggtggatcagctttatactttgaattccgttaggcatgtatgcaggcagaagctggagtatctggaagaggttctggaatgtttccgggggaaatgtctgatcaatattgacagatcatggttttactggaaggaaatcatagcacttctggatcgaatggatatgaaggatcaaatccttttaaaatcaggagtggaggaagatctcctgagggaacttgaggaaagcggcacagagatcatgtatatgcccatcatgaaacatccggaagaatgggatattttaaagaaatataatatcaatgttgcagcagcggaattgatttttacagatttagaaagtgaatttttaaatccggagtttatggggcaattaaaggaggcaggaattgcaccatgggtgaatgccattacactggatgatgatacgattctttcagggcttttggatgataataatgccattaagatcggttatgaggaaacatggggaaagttaatggatctgggatttgaaattatccagactgattggccggcgttgttaaaaggatacatattaaataaatttaaggaaaaataggagaaaagtcatgaaaaatttaaagaagtttgcagtacttggattatctgcagctatggcattgtcgctggctgcctgcgggtcaggcggcaaagaaacaacggccgatgggactgctcagacaacaagcggtgaggtggataaaagccagaagctgatcgtctataccaactcaggttcaaatggcagggatgcgtggttaaaggaacaggctgctgcggcaggctataacatcgaagttgtgcagattcagggcggtgatttagctaacagaattattgcagaaaagaataatccccaggcagacatggtatttggattgaattccattgaatatgagaaactgaaaaaggagaatgtgcttgatcaatgggaaccttcctgggttggagatgtggatatgtccctgggagataaagacggatattactatccgatcgtcattcagccattggtgaatatcatgagtgctgatttacaaaatccgccaaaagattatacagacctggtgaatccggagtggaaggataagtacaatatcttaaattttggcggcggcacgggtaagacaattctggccagtttgctgattcgtttcagagatgacagtggggaatatggcatttctgataaaggctgggagtttgtaaagaactggattcagaatggacatatggagcagcagggcgaagattacgttggaaatgtaatttctggttctatcccgattacagagatatggggcagcggtgtgctccagaatcagacagagagaaattacaaattccagatcatggtcccggaagcgggtgttccgtatgtcacagagcagattgcgatgatcaaaggctcccggaagaaagaccttacggttgattttgcagactggtttggttctgcagagacacaaacagcctggatgaagcagtttggtaccattccgtgccagccaaaggcactggaggaggctccggcagatattaaagaatttattgatctggttcatccccaggatatggattggggctttgtagctgagaacattgaccagtgggtcgagaaatgtgaacttgaattcttacagtaggtgatggagggcggtatggtttatgagaataaatgataccgcctttttgcaaggagaaacaggatgattgaatttaaaaatatagaaataaaatacggggattttacggcaattaaagatttgaatttaacaatccaggatggggagttttttacatttcttggcccctcagggtgcggcaagacgactaccttaaggtctttggtggggtttatcgagccaagtgccggtcagatcgtgattgatgggaaggaggttactcatacaccggtggaggagaggaaaatcggcatggtgttccagagctatgccctgtttcccactatgacggtatatgagaacctggcatttggtttgaaggtcaagaagctttcagcggcagagattgatcggaaggtaaaagaggtcgcgaaagtaattgaggtaaaggacgaacatctggtgagaaatgtgtcggaattatccggcgggcagcagcaaagggtggcacttgcaagagccattgtcttagagccgaagattctgtgtcttgatgagcccctctctaatctggatgcaaaattaagggtgggacttcgaagcgagcttaaaaagctgcaaaaaaacctggggattaccacgttgtatgtcacccatgatcaggaggaagcgcttaccttatctgaccggatcgccgtatttaacaacggattcgtagagcaggtaggtaaaccatatgatatctataaccattccaaatccgaatttgtctgtgattttatcggtgaaatcaaccgtttgaatccagtggtgatcaatgaactaaagaggcagacaaattgcaggctggatgaaaataaaagtgcctatatccgcctggagagaatcagcttagaagaaaactcaggctatgggaagctgagcggaatgataaaagattatgattataacggagttatgaccaaatactctgtagatgttatgggctgtatgcttcgtgtcatccatatcaatgacggaatgccatttttagaacctggtcagacattggatttatacattgagccgaaaaacatcatgcaattttaaaaggagggtgtttgtatgaagcatataatcagaaagcagtctttcagtatacagaccttgatcttaaaaattgttataatatgggcgattgctgcatttgtcatatatcctaacgtgaacctgatgatcggtatgttttataaaaacggccagttttccactgaagtattcagtaaggtatttagctcagccagagccatgaaaagtcttgtaaacagttttattctggcatttactcttgttgtcaccgtgaatatagtgggaacgttaagtgtccttttgacagaatactgggatattaagggggccaaggtattaaaacttgcttacatgagttctttgatctacggaggagtggtccttgtatccggctacaaatacgtttatggggctaatggattgctgacaaaagtattactgatgatcgttccgggcatgaatccaaactggtttgtaggatatggggcagttgtatttgttatgacgttctcctgtacccagaatcacatgatgtttttaaaaaatgccattcacggactggattatcataccatcgaagctgcaaaaaatatgggggcttccggcagcagaattttctttaaaattgtcatgcctgtattaaaacccaccttttttgccatcacaattcttacgttccttacagggctgggagccatgtcagcaccgttaattgttgggggagatgcttttcagaccattaatcccatgatcattacatttgcaaagtccagttattccagagaggtggcagcgttcctggcaatcctgctgggacttgcaaccatgcttttattggcagtattcagcaaaattgaaaaaggcggcaattacatctcagtatccaaaacaaaggcgaaactgcgcaaacagaaaatcaacaatcctgtgtgcaggttacttgcccatgctgttgcctatgttatgtttgtcatatatgtcattccgattattttggtgattgtgtattccttctgcgattcccttaccattaagacaggtaatattaccatggcttcgtttactgcagctaattaccaaaagctgtttacaagtgcagatgccgttaaaccgtatctggtaagcatcgtgtattccctgctggcagcggttgcagcagcagtaattgctgttatctgcgtcagattcgtgcgggccgctaaacacaaatatgatgtattctttgaatggggaatgctggttccgtggctgctgccgtctaccttaattgcacttggcctgaccataacatatggagaacgtcatgcaattctgtttcattatgttatggtaggtaccctggtgctaatgcttgtgggttatacggtagtcaagcttccgttctcttaccggatgataaaggcggcattctttagcattgacgatgatctggaggaggctgcaaaatgtatgggcgccagtaccttttataccatggtaaaggtaatactgccggtcattttcccggcaatcatgtccgtcattattttaaattttaatggtatgctgtcagattacgacctatccgtatttctgtaccatccattattccagccccttggcattgttattaaggcagcttccgacgagtctgcagctattgatgccaaagcgatgggttttgtatatacggttgttttaatgattctttcctcggtcgctttatattttggacaaggaaatggaatggcagcaatcagacggttcaaacagagacgtatccagaggaaaacaataaaagaattaaaataaagctgggattcttttcgtcataacattggaaggaggggggcaatacttaaaaagagccggtttagaacatgtaatagaggaggaagtatgaggacggtagctgaagctgtagaatatttggaaaggataaattcaatttcaatcagtgtgcgcattctgatgtctatgatttgcggcggagtgattggcattgagcggggaagatcccgccagccggctggaatgagaacctatatgctggtttgtatgggagctgctgtggttatgatgacaggacagtacatgtacgatcattttcagagtggtgatccggcgaggctgggagctcaggtaatcagcggcattggtttccttggagccggaagtatcattacttttggaaagacaaaaatcaaaggattaaccacggcggcaggtctttggacagcggcatgcatcggtctgagcattggaatcggattttacatagccggaatcattgctacgttggcagtatctctgatcatgacacagtttaaaaaattggagtattatctgatttttgatgatgcgtggctcagcttgtatgtggaaatgtcagaggatgccaacatggcggatatttccagggaaattgcaggttttggtttggaaattggtgaggtgcaggttggaaagaagaggaaaggatttcagaaggctgttattaatctgaaaaatacagagcataaaggccgggaggaagtgctgaagtatttagaaaatatggaagagcttcagtttgtaaaatatacgtcttaatgaaaagccgccatacctgtgggtgtggcggcttttgccatcacacgaaagtgcgtcaaaggcccctgtgtattcccttcatatccagcactattttctccttacatcaaaaagtttccaataccattgtaaaaaatgataaaaaaggctttacattcgccggacaatgtgttaatatgcatatgtaaccggttacataaaggagatatgacatgaatatacgggatattgccaaaaaagtgggcgtttcttctgcgaccgtgtccagagtgataaatcagtccggatacgtaaaggacgaaaccaagcagaaagttttagcagcgattgaagaggcggatttcgtacccaatgccatagcaagaagtttaagcatccgcgactcttccagtatcggggttattgttcctgatatagccaatgagtttttttccagcattataagcggaatgggagagatggcggccaataaccagtataacattgttttgtttgacacaggtgaaatgcaggaaagagagcatcagtacttacaggtggcagaaggccaaaggctttccggtttgatcataaccccggtttcggaactggatatggtgaccagggataagctgatacaattcgaaaataaaggaattccggtggtgttggttgaccgtaatattaaaaattccagcttagatggggtttttgtagagaatgacgccgctgcttataagggagtggaagcgctgatccatgccggtcaccggaaaattgcaatcattacaggtcccagtacttctatgccgggaaaggaccggttaaaaggatataaagctgccttaaatgattatgagattgaacttaaggaagagtatattgtatccggagatttcaagatcatcaaggcatatgaacggacaaaagaattgctggagcttccggatcctccgactgcaatttttgcttccaataaccagaccagtctgggagtgcttaagtatctcacagagcacaagcttaaaatgggcagggacatatcaatggtgggctttgaccagattgaatcccttaaaataattgattacagattatctaccatcgaacgtgatgcaaagaagcagggacatgacgcaatggcaatgctcattgacaagctgtcccataaggaaagtaaaagctccggaagaaaaatctttgttccgtatcaggtagtgcttcgcgggtcagagttaataaaataggctgcggtaagcagtttatttttcccctgagtatgtaaccggttacatactcaggggatgatagatcatgaaagaaaagaggagaagaaaatgaatattgcaaaaatggtggatcacacgatgctgaaggcagatgcaacgtcagaaacgatcagaagatattgtacagaagcaaaagaatatggatttgcatccgtgtgcgtgaatacatgccaggtgcctcttgttgcccaggaattaaaaggcagcggggtagctgtctgctgtgtggtcggctttcctttgggagcgatgctgactagtgcaaaggcctttgaagcctccgaagcagtgaaggctggggcagatgaagtggatatggtaatgaatatcggcgccatgaaggacaagaattataatatggtgcgtgacgatataaaagcagttgtggaggcttcccagggcaaggctgttaaagttattttagagaactgccttttaacgaaagaagaaatcaaaatggcctgcgagatttcagtagaagccggggctcatttcgttaaaacatccactggttttagtacaggcggtgcggtaaccgaggatgtggcacttatgaagcagacggtaggagaccgggcaaaagtaaaggcaagcggagggattcgaacaccggaagaagcccaggatatgataaaagccggagcagaccggattggggcaggtaacggaatagccttgttataaggagaggagaagggtcatggggaaaaaagtaacagttttcgggagctttgtagtggacctgatggggagatgccctcatcttccggttccgggagaaaccgtgaaaggaagtatttttaaaatgggtcctggcggcaaaggattcaaccagggggtagctgcccataaagcgggagctgatgtgaccatggtgacgaagcttggagaggatacatttgcagatgtggcattatgtaccatgatgaagctgggaatggataccggacggatattccgtaccggaaagacagagaccggcagtgccctgattatggtggatgaaaacaccagccagaatgaaattgttgtgattctgggggcctgtgacacgattacagacgaagaagtggaatctatatcagacctgttggatcagtcggaatttctgctgacccagctggaaaccaatctttcctccgtggaaaaagtcattgatattgcatatgagaaaggcgtaaagatcattttaaatacagctcctgtacagccggtcagcgacagcatgttaagcaaggtggatttaatcacgccgaatgaggtagaagccggcatattaaccggtataccggtagacggggaagaaagtgctggaagagctgcagacttcttttttgaaaaaggagtgaaaaatgttctgatcaccatgggcggaaaaggagtttatctggcaactcttaagaagaggggacttctgcctgcttaccgggtcaatgcaattgataccacaggggcaggagatgcgtttaacggcggcctggtggcggcactggcagaaggaaaggatttatgggaggctgcagcctttgccaatgcattagctgctatttcggtacaaagaatcggaactacgccggccatgcctgaccgggaagaaattgactcatttatcagggagcatgagaaggaggaacggtcatgttaaaaacaggaattttacaccctcaattagcaagggtcatggcagagctcagacatatggatatgctggtaatcggtgatgccgggttacctattcccaagggagtggaacgggtggacttaggctggaagccgggaaacccttcttatctggaggtattggaagaaatagaaaagtatatggtaacggaaaaggccatatttgcagaagaggcacttgccgtaagcccggagcttcataagaaggccctggcgcttctgccggaagaaataccggtagagtatgtgccacataaggaattaaaaacgatcacggaaggggccaaggcgatcatcctgacaggcgagtttacaggatacacaaatgtcatattggtctcaggctgcgcatattgaccagaagcaaaggggaagtggtgaaatcatatgggaggaaggttagttttaaaactggaatcaatcgtaaagacgtttcccggtgtcaaggcacttgacagggtgcatttagagatttatgagggagaggttcatgctctgtgcggagaaaacggggcggggaaatccaccttgatgaaaataatcgcgggggcacagccttatacttccggtgccatgtatctggatgggaaagaggtggtgttccattccgccaaggatgcagaaaaacatggaatcgccatgatctatcaggaatttaatatggttccggaattatcggtggcagaaaacatgtatcttggaagacttcctgtgaatcagtttgggaaagtggattggaacaagctataccgggacgcacaggaaaatctggatcatctgggtttaaagttcagtgcaaaggccagggtacggaatttatctgtggcagaggcacagatgacggagatcgccaagtgcctgaccatcggcgccaaaatcatcattatggatgagcccacggcagcgctggcggaagaagaaattcagattctcttccggacgattgaggaactgaagaaaaagggaattgcgatcatttacatttcccaccggatggatgaaatttttcgtatttctgaccgtcttacggttttccgagacggaaaatttgtggcgaccaaattcattggagagacagattatgaagatgtggtatccatgatggttgggcggaatgtatctaatctgtacccggtaagggattataaacctcaggaagtggtatttgaagcaagaaaagtaaacagccgcggggttcatgacgtcagcttaaagctccataaaggggaaatcttagggattacaggacttttgggtgctggtaccatagagctttccaagttgatttacggcgccatgccaatggaaagcggagaaatttatgtacacggtgaaaaaaaggattgttcctctccaagaaaagcattggaagcaggaatcgggtttgtctcagatgacaggaagcaggaagggcttgttttaataagaagcatcaaagaaaatgtttccatgtcttctttaaaaaagctgaccaaaggattccggctggacaacagactggaaatggaacgtgtaaaggaacaggttaaggcgctgaatattaaaatcagttccacgcagcagcttgccggaaagttaagcggcggaaaccagcagaaaatagtgtttgcaaaagtgcttttagcggattctgatattctgattttagatgagcctacacggggagtcgatgtgggggcgaaggcagagatctatgccattatgaacaagctgacagaggccggtaaaagcatcctggttatttccacggatttaccggagctgatcggagtcagtgaccgcgtcattgtcatgcgggaaggacggacggtattagaaatctccaaacaggaaatgaatcaggaaaaaatattagcgcatgcgtctggaggggtaagtgaaaatgaatcaggaaactaagaaacggttaatcaaccaaataaatatatatcgttcggttttgatcttgctggtcatctgtatctttgccgcttttttgtcaaaaagttttttaagtgtttccaacttatttaatgtttttaagcaggtgacagttgccggtattatcggatgcggcatgacctttgtaattctgaccggcggaatcgatctgtccgttggttccattctggggtttgcaggagtggtagcctccggtgtgctggcttccaccggcaatactttactggcagtatttacagcagttgcaatcggaattacctgcgggatcgtcaatggattttttatttcccaatgcggcattcccccgtttattgccactctgggcatgatgaccctgcttcggggctgtgttttgatctataccaaaggttctcctattccggtaaaaatagattcttataaatttattggaaaaggtacggttctgggggttcctgtgcctgttattatccttatagcgcttttcctgctggcccattacattttgacacaaaccagctttgggcgcagtatttatgcatttggtggaaacagggaagctgcccgtttatccggaatttctgtaaagaagacggagtggatggcttacatcatcaacggtttattaagcggcattgcggcagtggttttaacagccagactggggtctgcccaatccaccagcggacaggggatcgagatggatgccattgcagcggtcatacttggaggaaccagcttaagcggaggaaccggatttgtactgcctacggtggtaggcgccatgatcatgggaataatcgataacattcttacgcttatgaacgtcaatccacatgccaccaatattgtaaaaggcgcagttgtgcttattgcagttctggtggacaaaaaggtcaaggatttatctgcgaaagcagaataaataaaactattaatgtaaaaaagaagggaaggtaaaaaattatgatgaaaagaaaacacatggcagcaatggcagcagcaggacttgttctggcatcactggcaggatgcagcagcggagagaaggcgcctgaaaccaagcaggagaccacacagacagaagcagccaccacaacagcggaagcccagtccaatgcagaggctaagccggcggacaagaaatacgtggtaggacttgccatgaatactcagacaaatccgttctttgtagacgtaaaagacggggtacaaaaagccgcagacgaattaggagtggagctttatatcacagatgcccaggatgatcctacgatccagatgaaggacatcgaaaatctgatcaccaaaaagccggactgcatcatcattgatacctgtgattcagatgcaatcgtttcttccattgaagcttgcaacgaagccggtatcccggtgcttaccatggaccgtgaagccagcggcggagaagttgtttcccatatcggctacgatgccattaaatccgggaaactggcaggccagtatctggtggacacactgggaggcaaaggaaatatcgtagaaatccagggtattatgggaaccaacgtggctcagagccgttccaagggctttaacgaagtgataagccagaatccggacatgaagatcgttgcatgccaggttgcagattttgaccgttccaagggcatgagcgtaatggaaaacatccttcaggccaatgaccacattgacggattatatgcggcaaatgatgaaatgcttcttggcgcattggaagcaattgaagccgcaggccgtctggatgagatcaccatgatcggctgtgatgccattgatgataccattgaagccattaaagcaggaaaagttgaggcaaccattgcagaacccccattcttcctgggaaaagcaattatgaactctgcatacaactatcttcagggaaaagaagtagaaaagtatgtgatcctggacaacgaactggtaacagctgataatgtaaatgaattagttacaaaagaataatccggatttatgccggctggggcatcagactgagtggatcggtctggtgccccggctctttctgttgctgtgatcatatttgtaaattttgaaaagattttcattacagtttgtgatataatttttacagctgccaggcattgtttccaatccgcttcgcagactgattcggttaaataatggcggctgtaatcaaaaatctgagccaggaggtgttttcatgattatttccctcgatccaatgactgtagaaaaattaacaaagacagagcttgaaatcgtaaattttatcaacacccatgaagatacccttcctgaaatgtcgattgtagatattgcatttgagacttattcttctccctctaccgtttccagagcaatccgcaagtgcggattgaacggatttaatgagcttcgctaccgttcggtcaatcatgcaaagagcgaggaaatacaagagatgaatgagatactcaataagactcttattgaagctcagaaggttcatgaacgtatttcccttaccaatgttttggaaatcataaaatgtctggactctgcccggcagatatcggtgttcgcaagaggtcccacaacttatgtaggccaggagttttctttaaaacttcagcttcttgattacgatgtcttttttacggatgatcccaatatcatgcaggtaaaagcttcaaaactaaaggcagatgatgttttgtttctcctgtctttaaacggggaaactccggagctgatatcctctgcttttacagcttttcatcggggaaaccgggtgatcacctgctgctgtaatgagaagtccaaactgttcttatacagtcaatattctcttgtgggatataagcactctcatcaggctattaaggaatttgaggtctcatcaagaattgcattgcatatgatttgcagaattatcattgattatatatcaacctatcgcaagaaataacagggcggatgaaaaatccggccctttttttatatcttaaccttgcttttacaggaaatgggttttcaaattctgaaaagattttcatgtggtttccctatataatggcaaatgagcagaagttctgaaaaaaggtgaggtgcaataaagatgatctatactttgactacaaatcctgcgattgatatgaatatttcaaccaatgggatacaggcaaaagttgtaaaccggacgtatggtgctgtttatactcccaatggaaagggcctgaatgtaagctattgtttgaagcggtttcatatccagtcaaaagttcttggctttttcggagatttttcaggaaagtatatcgttgaggagactcagaagaaatccattgaaacctttcctgtctgggtggaagatattacgcggataaatatttttttaaacgatgggaaagaggagtacaaatttgtgaatgaagggtcctatgtatctgacaaaaagcaggatgatatgctccggattatgaaaggacttgctgatttagatacgctggtaatcagcggaagcctgccaaaggggatcggaaaccaattttatgacgaggtaatggaaatctgcagaaaaagacgggtgagggtgattttagatatcagttccgattatttaaaggaattgatgcattacaggccatatttaattaagcccaatgatgatgaggtaaaagatatttttggaatcattatacgggatgaagatgatatgatagatgccctgcacgatctccatgaaaaaggggcgcaaaatatcctaataacactgggggacaaggggtcttatttttataatggaaaatcagtatattttgcaggcacaaagaacgtggagctggtcagttctgcctgtgcgggagatgcgtcccttgccggttttttaagcatatggcttgatcagcccgaagaggtggaacatgcattaaagcgttctgccgctgtgggagcaaacgtggctgagagcaatggacttgggcctatggaccgggtagatgagtatgaaaaggaaattgcagtcagaagagtggaatgagcatgaagttgttacatgattgtcgcaggaataggagagataaaaatgccgttagttacttctaaaaaaatgttacttgatgcccagaaagggaaatatgcagttggcgcctttaacgtggaaaatatggaaatggtcatggcggtcatagatgccgcaaaggagcttcaggcgccggtgattttgcagacaacgccgtctacagtaaaatacgggggcttaaacctgtactatgccaatgtaaaagcagcagccgaacgcgcttctgtccctgttgcccttcatctggatcatggaagcagctttgagctggccatgcaggcctttcgtgaggggtacacctccattatgatcgacggatcccattttcccctggaagagaatgcggctttatcaaagtccgttgcagatgcctgccatccgtcttgtataccagtcgaaggggaactgggccgcgtaggaggaaaagaagatgatttggaaggcggcaaaggaggactgacatcaccggatgaagctgcttattttgtagaaaagacagggatcgattatcttgcggtgtccattggaaccgcacatggcgtatactcaggggttccaaatatccgggtcgatatactgaaggagatcaagaaaaaggtgtccataccccttgtacttcatggaacttccgggcttgcagatgaaacagtgcgggcgtgcattcgggaaggtatctgtaaggtcaattatgcgacggatttacgaatcgcctttagtgaaggggtgaaagcggttttaaatgaaaatcaatctgtaattgatccaaagacttatggaaaaagaggcagagagtttgtgaagcaatatgtaatgagtaaaatttcagtttgcggcagtgtgaggaaagcaggaaattatgaataagctgattaattgccagaaccggattgtagaggagatgctggagggttatctgtccctgaatccggacctgtattgtaaagtacctggtgttatgggaataaaaaataaaagagaagtagataaggtttcggtggtcattgccggagggtcagggaatgaaccatgggttcttggatttgttggagatggccttgctgacggggccgccctgggaaatgtctatacagctccgccttcccgtaccgtattggaggtgacaaggtcagtgccacatgataagggagttatctttatcgcggcaaaccatgccggagatgtactgaattttgaactggtacgtgagctggctgaattagaaggaatcaagtcccattgcatttatgtatccgatgatatttcttcggctcccctggaagaaaaggaggatcgaagggggatcgcaggtatttcctttgtggtcaaaattgcgggggcagcatcaaaggagggtattgtctggaagaaatgaaacgggtggttgagaaagcaggcaaaaacacaagaacctttggtgtgaccacatcaccgggatatatgccaggctcaggagaggcaatgtgtgaattgccggatggttatgtggagtttggaatgggatttaatggagaaccgggaataaaaagagaggtgctgtcatcagcaaataagataacagaagcgctcatggaacagctgttatatgaggtgcctacaggctgcgaagctgcgcttatggtgaatggttatggattcaccagcatgctggaattgtgtattgtaagccggaaagtgattgagatcgcagagacaaaaggaattgtcaatgtccattcatttattgatactcttttttctcctcaggggaccggcggcttttccgtatcaatcctgattctggatgatgagctgaaaaaattataccaaagaccctgtaaatctccgttattccggtttcaaggaggcagcagatgaatgtggagaagctaaatacagaacaggtgaagcagcttttcctgtatgctgcagacgggattgtgaagagtgagccgtatttgacggaaattgatatgaaaataggcgatggagatcatggcacgggaatggaactgggatttaaggcagtcctggaacagcttccctcactggaagcgaaatctgtagaatccgtttttcaggaattgggccggatcttgcttgataccatgggcggcgcctcaggggttttgtttggcacaatgtttatcagcggcgttatcaggcgaaagccctcgccttattatgaactttcagattttgcggaaagcttccgtatatccttagatgccattatgcagagagggaaggccagggtcggagataagaccatggttgatgcattggagccggccgttgctgccttagaatacgcagcttcccagggactggatattcatgagggatttttcatggctgcggaagcggcaaaaaaaggtgttgaatatacaaaagaaataaaagccagatttggaagggcaaagtattacggggacaaggccattggacttcaggatgcgggtgctacatccgtatggctgatctttcaggcaatgtcggattggatatcaaatcacttgatataaataaaatttatgggaggttacgtaacatgaagaaagcattaaaaagaatcttagttgccggagcagtggttttaagtctggcgggatgtcagaaagtcaggcaggaggcgccaaaggttgctagtgaaggaaaccagacagctgcagaaaccaaggaagctacggatgctgcagaagcgaatgcagaagacgggaaacctattacggtcggcgtcagtctgttaaacaatgctcatgttttctacaacaacattgaggcggctatgaatgaaaaggcaaaggaaatgggctatcaactggttatccaggatgcagcaggagacggaaataaacagctgaatcaggtgcaggattttattacacaaaaggtagatgccattgtcatttgtcccaccaactccgccggaagcaagtcaatggtagaactggctgacgcagccggtataccggtatttaccatggatgttgcgtcagatggagaggtaatcagccatatttcaaccgacaactacagaggcggagaactggcggcagaatatgcggtggaacatattttgaaacagaaaaccggccaggcggcagttattacatatgcggagattgaaggctgcgtacagcgtgaaaaaggcttcacagaatggcttggcaaaaatgctcccgatgtatcggttgtagatgtgcagaactattccggtgaccagggaaaagcggcagaggttatgcagaatatgctgttaaagcatgaaaatcttgatgtggtattctgcgtaggcgatccggcagccgttggtgccatgtcctccatcaatgcggtggaaagtgatgtgaaggtgatcggttttgacggaaatccggaaggcattgaggcaattttaagcggaggaaactggattgcagatattgcccaggaccccacggccattggaaccacaaccctggaatgtattaagaagtatttaaccggtgagtctgttgaaaaattaattcctatcccaccaagagtcattgatgcaagcaacttaaaatagcaatataacctacaacggaaggagtgagatgcaatggaagaacaggctttcgttgctttggaacacattagtaaatccttccctggcgtaaaagcattggatgatgtttccatcagcttttcccctggcagagttcatgttctgctgggggaaaatggtgcaggaaaatctacaattattaagattatttcaggtgtatatcagtcggatgaagggaatctgattgtcagaggaaataaagagagatttgagaacaccagagaatctttagctaagggaatcagcgtgatccatcaggaactgagtgtgataccggatctgaccattgctgaaaacatcttcctgggaagggaacctaaaacgcccttagggttgattgataagcagcagatgaaccgggaagcaggtaaattgctggaagcattgggaatgcatttaaatccaaagacatttatcaaaaaactgaccaatggggataagcagatggttgaaatcgcaagagcggtatcccaaaacagctcactggtcattatggatgagcctacttcctctttatcagataaagaagtgggggctttgtttaacgtcataaagtctttgaaggaagagaatgttgcggttatttacatatcccaccgtttgcaggaaatacgtgagattggtgatgatatcacaattttaagggatgggaaagttgtgatgagtttgcccctgccggaaatttcagaagaagaaatgatcaacaagatggttggcagagaaatgaagcagttttattaccggtctgaaaatgcggtgacggatgaaatcgtgttgtcagtagacaatctgggacgaagcggttcttttcacaatgtcacgtttcagctgagaaggggagaaatcctgggtgttgcgggattgatcggcgccgggcggacagaagtaatgagaactgttttcggcgcggatgccccggactctggttccatgcttgtttatggcaggccataccagcctaaaacagtgaaggatgcggttgcttccggtattggtctggttccggaggacagaaggggccagggacttcttctggaaaagagtgttgccgtcaatacaaccttatctagtctgcgtcgaagatcaaaaaatgggttgattgattttgcatgggaaaagacggcatctgaggaatatgttaaaaagatgggaacgaaaactcccgggattaagaccaggattaaaaatctctcaggaggaaaccagcagaaggtggtaattgcaagatggcttcttgcaggctcacgcattttgattatggatgagcctaccagaggaattgacgtcaatgcaaaagctgaaatctacaacttaatgaaagagtttgtagaggccggaggaagcattatcatggtctcttctgatctgcctgaaattcttggagtcgcagaccggattatgatcatgagggaaggaactgtttccggatttttagatacgaaagaggcttcggaagaaaggattatgggattggcaagcatcagcacagaaagttccgggagggcaaaagaatgaacacacaaaaaccaaataaatatctgacatttgtaaaagacaataccatgctgattttcctgatcctcttatttgcactttgcctgctttttgttcccaggtttgctaccatcgggaactttaagaatgtattgattcaaattgcgattaacgcattgatcgcaacgggcatgacatttgtaattctctctgatgggattgatctatctgtcggctccgttgcagcacttgcaggtattgctgcggcagcctgtattaagctctttccggatgctgggatagggctgagcttgtgtgtgattgtggcatcgtctgttgcggtaggaggaatttgcggaagcatcaacggattatttgtatccgttttaaatgttccgccttttatcgccaccctggcgatgatgaatgccgcaagggggcttggatatgtttttacagatgcaaagccaattttcggacttccggcttcctttggctgggtggggctgcgctccgttggtccggtaccggtgtctgttatacttatgtttttaataataggcactgccatttttatacttgccagaacgtgttacggcagatacatttatgcagtaggaagcaacactgaggttgcaaagctcagcggcatacaggtcaggaaggtcaaaatgtccgtttatattatctgcggaatcctggcagctctggcaggcgctgtactggcctccaagctgcaaaacgggcaggcgactgcggcagccgggtatgagttgaatgcgattgccgctgtggcaatgggaggcaccagcatgtccggaggacggggcggcatggtgcagacgatctttggcctctttgttatagggatcattaataatgcgctgagcttgctgggcatatcctcatattggcagaccattgccatgggcgtcattattctcattgcggtggtggttgaccggttacagagcaatgagtgatgccggtaataatatatttccctgcaaaggattgttttttattctgagcctctttgtggtatgatgaaactaaaacaggagaagattctggtaagagcatgtaaaattctatgatttctgatattaaccgcacataaaatcaggcagagttctgtcaaaggatgttggtaaaacggaacatttgctgaacataaaatctgtgattatccgcagcaaaaatatcaggaatttaatcaaaaactcatgtatgattgttttgaaaggaggaataggcaatgaatacgctggctcaatttaatgatgttatggcttatatagaaagaaacttgatgcatgatatggaaccgggtcagatttcacgtatatccggctgctcggaataccatttccgcagaatgttttcttttcttgcgggaatgccattaggtgaatatattcgccgcaggcggctgtcggtagctgggctgatgctgcagacggaatcagtaaaagtcattgatttggcgttacagcttggctatgaatcaccggaagcttttagcaaggcgtttcaggtgatgcatggagtgcccccatcccaggctaaaaaagagaatactgaacttaaagtcctgcccccaatgacctttcaattaacaatcacaggaggaatggaaatgaattatcgtgttatagaaaaagaggaatttcatattgttggatttaaaaagaggattacaatgcagtttaaagggatcaatccgcagatggactcattggtacaaaaactaacgcctcaagttattgaggagttaaaaggtttatgcgatgtggagcctaaaggaattctcagtgtttctgctgattttaatgagcgtaccacagaaggctcccagcttgaccaatatatcggtgttgccacttcaaaggcggtttcaaacggctatgacatcctggatgttccagcctcaaattgggcggtatttaaagcggcaggtacttttccggatgcgattcaggatacatgggctaaaatatattcggaatggttccctgcatcaggatatgaattgaccggtgggccagagctattgtggaatgaaacccctgataccagtaagccggattataaaagtgagatatggatccctgtccgcaaaattgacggtaaataaaagccgtcttccggcaggcaatatgttgtgtacaataagatatggatagtcatggggcggttttgcaatcggaaagattcaaagccgccgctttgctttgggataggtgatttgctggcgcggaaaacgcctgcttgaaattttgaattacttatgtaatgatagagatatggaaaaacattttttgcaggatcatgtacccctgcagttttatgataatagggtaaatagaataaatttgaaccaataaatgaaataataagaagagatttataataaaggcgaaatcaaaacagggcttctgaactttcagagccttgtttttcattttctgcaacttttttacataagaaatcatctatataacagaacggcaaaaatgtctgtgaaaggacagaaagggtaacaaatgagacaagagatctatgataaaatgacaggctatattattgaaaatcagaaaaaattttatcggctggccttcagctacgcccaaaaccaggaggatgccctggatattgttcagaatgctgtattaaaagccctggatcattatgaatccttaaaaaatcccgacgcaatcaagacgtggttttacagaattcttgtgaacgaaagcatttatttcctaaagaaggataaaaaggagatcgcatcgggagaagaactgggtctggagatcccctattatgagcagggctatgaaccatcggaggatctttatgatgagatcaatcagctggatacggaaacacaaaacatcattaagcttcgcttttttgaagaaatgtcgctgaaagaaattgcagagatcaccggtgccaatttaaatacagtgaaggcaagactgtaccgggggctaaaattgttaaagcagaatattcaggaggtaaatttatgaaccagttggatgatgcaaaaagaagataccatgagactcccattccggaagaattaagcatacgcatacagggagccatagagcagtttgaaggaagaaaggcggcaggcagccggaatggatttcgaggcgggagaaaacaattctataaatggggactgggaacagcagccgctttccttattacatttaccgcggcgctgaatacaaacacagcctttgccagggaagtgcaccgccttcctgtcgtaggcgctatcgcccgaatcctgaccgttagctcctacaagaagacggttggggatgaaaagatctcggtagaagtgccggggctggaatttatccaaaacgatacccacggactttccaagcagataaatgaagaaatccgtgagatatgcagccaatatgcggatgaatcgttggagcgggcggaggaatacaaaaaggcatttctggatacaggaggaacagaggcagaatgggcggagcataagatcgagatcaaagtatggtatgagatcaaggcccaaagcgatgcttatctttccttcgcagtaaagggaacagagagctggacctctgcttacagccaggaaaagtattataacatcgatttaaaatcagaaaagctcctgaccctggaggatgtcctgggagaggattatatcaataaggccaacgaaagcattaaaagccagatggaggaaaaatcccgccagcttgggatcttattctggactcctgaggagggcggctttaagaccatttcccatgagacaaaattttatataaaggataatggaaatccggtcattgtttttgacaaatatgaaatagcacctggagcggccggggcggttgaatttgaagtgaaaagataggaagactggaaaacaagcgtgttattcgttgtgaacgatgcgcttgttttcctttgcaggacggcagcttccgcactcttgcactttttattctcataagatacaattaaaccctccactataacaccagactcttatacgatgttattattgcggaaaagaatggcggtgacagaataaaatgaatacttacaatacatcggaaattgctcacagcataggaatccatcccaatacggtacgtctttatgaagagctcgggctcattccaaagccagagcggagggcaaacggttatcgtatttttacagatcttcatatggaacagatgaagttcgcaagaatcgcactaaaggttgaggttttgcaaaatgggttgagaaaacaggcaattgctattattaggacctcggctgccggaaattttaacaaggcggttggtttgacggaacattatttgcagcagataaaaaatgagcagaaaaatgcggaagaagccattgagattacccaaaggctgttatcaggcggcagccagggacaaaagaccggaaccatggttttaaccagaaaagaagcggctgattatttacaaatctcaatggatgctttaagaaattgggaaatgaacggcctgctcactgtaaaacggaaacaaaacggttaccggatttatacggaggaagatatgcatcggcttaaaatcatacgttccctgcgctgcgggaattactccctttcagcaatcttgcggatgctgaatgccttatcccaaaacccagaagcagatatcaggcaggtaattgatacaccggacaaagatgatgatattatttccgtatgtgataagcttctcacctccttgcattacgccgaggaacatgcggaagttatgctggcccaccttaagaaaatgaaaatacaatttgaaacagaccctacactttaacaccagactttactctggtgttattctttttgtgaatagaaaaaacaggagggattttattacatggaaacaactattgaagtgaaagggctgtgtaagtcctactcccaggtgaaagccatagagcatattaatatctcgatttgcagcggggaggtgtttggcttactgggagcaaacggagcgggtaaaagtactgcaatcgaatgtatcctgggaacgaaaaagcaggatagcggaacaatatctattttaggaatggatccgcaaaaagaccggaaaaggctttttcagaaggttggcgttcaatttcaggaggccaattatcaggataaaatcaaggtatatgagctttgtgaagttactgcttcgctttacaaaaacactctggattatgggattcttctggaacagttcggactttcggaaaagttaaaaagcatggtcagtgaactttcaggcggtcagaagcagcggctttttattgtgcttgcgctgatcccggatccggatgttgtgtttttagacgagctgacaactggattggatgccagggcacggcgggaagtgtggaagagtcttttacagttaaaagaaaaagggatcaccattttacttacctctcattttatggatgaggtggaggccctttgtgataagattatgattttgaaaagcggggaaagcattttttgcggtaccgtacaggaagcggttgctgcctgtccatatgaaaagcttgaggatgcatatctttggtataccgacggggagggtgaatatgaaagcatttagaactttgcttaaaacagaagggaaattgtctcttcgcggattggatatgtttatttttgctatctgcatgccggttgcggcggttgtaattttaggagcagtatttggaaacaagcccgcttttgacagcgcagaatatacgttcctggaacagtcctttggtgcggtatcttctattgccatttgtgccggaggcgtgatggggcttcccctggttgtgtctgattaccggagcagaaagattttaaaacggtttaaggttacacccattgaccccgcccttatcctggcagtgcaggctttcatttacgccctttattccattgcatcccttatccttgtttacgcaacaggagcggtatttttcggatatgaattaaagggctcatggcttctttttttggggcatacttactggttatgctgtccatgttcagcattggcctgttggtgggaggaatttcgcctgacacgaaaatagccggtgctgcagccagcctgctgtattttccaatgctgattttttcgggtgcaactctgccttacgaggtgatgccggctgtgttccaaaaagcagcggatctcctgccattgacacagggaataaaacttcttaaggccgcctcactgggtcagccaatggacaacgttttcattccggttatggtgatgattgggattgcagtgatatgcatcagcatttcactccgctttttcaagtgggaatgacagattgtattggccggtttgacggaattaaccatatccatggattatgtctgcttttcttttttacactacttccttcacatggacgaacatgctataatgtcataagaaacggggcatagcaggggataatcatgttaaaagtattgatagcagatgatgaagaaaagatctgccagttgattgaaaagctgatcgactggcaggcactggatatgaagctcagcggtgtggcgaataacgggatcgaggcgcttgaaaagatagaagccctttctcctgatgtggtgatcacagatatccggatgccaggatatgacggcctggacctggtgaaaaagaccagggaactgaatgtgggagtggaattcgtcattatcagcggataccgccattttgagtatgcccagacggcgatcaaatatggggtcagcgattatttgctgaagcccataaaaaaacaggaactgacggaaactctggaaaagatcagggagaggtacaatgaaaaaaacgaacagctgacctacgaagaacgggtcaggcttgcaagaaaaagtgatgcggagaggctgcggaccacctggttttccagtgttctgtacagggacaggagcgaacaggattgtaccggattggaagaaatcaataagcagtattattatcagttaaagccgggctgctttcaaatcgtctgtgttaaatttgacggaatttccatgccagatgagaaaaacctggaatttctgacagaaaagacaactcagattgctgaacagatgctgaaaggccatgtatttgactgggaattgtatgtggaaaacagccatatttacatattcctcaattatggggaggagagcaggaagctcatccgcaggcagtgtaaaaatatattaaatgaacttgctgttctggaatccattctggaggggctccgggtgaccattggatttggaacaaccgtacgggatgccgcccagctaagaaattcccttaaatctgccaggcatctggtggaacagcggctggtggccggaaacggcaagcttttggaaggcgagctgcgcagctcctttcatctggcatcaagccagtggttcacccagtttaaccagagcatgaatacggcactggaaagcctggaccggcagcaggtaggagactgtctgatgaagctgaaggaagggcttttggaacagccggatatgaccggacatgagattttgcagatgtgccgggaagtgtgcaatctttacttgtttttcatgaaaaaccataagattcccattgagcagaatttcatggaacggtttaatcagggagtggaattttgttcctctgcaagagaggtcctgcgctttctgataaaggaaatctcttcttcctatgacaaagccgtagcaggaaagatgcaggaaaataaccgccccatccgcatagccaaaaaatatatcagggatcattataaggaggccattactctggaaaccgtcagtgaaatcgcaggattcaatcctacctatttcagttctctgtttaaaaaagagacaggaaagaactttctggaatttttatctgaggtgcgcatggaacaggcaaaaagcctgttaaaggaaaccaatttaagtgtggcggccatatgcggggaagtgggctacagcgatgtaaagtactttactaaaaatttcacaaagttttccggattaaaaccaaatgaataccggaagctttattcctgacagggaggaggcatatcatgaaggaaaagtttcggtttctgtccgtcagagtgattcttctcttgtcaggcctttttgtgggattcttgcttttacttggatatgccctgtatttaaccatgggtacgccggcacaaatgtggcttttcatggcagcagcccttttgatcgccctgtttttttacggaggatattatgggatctataaacctttggaggaaaccaaacgggtagagcggcagtttgcctcaggcagtgttttaaatgatttatttaaaatccgatatccttacgacttggaatccgagcaggttaaccaaagattcttagaaatgcttggaaccagagaactgatcaatgtatcaaaaaagcaggcggaatatctggccctgcaaaaccagatcaatccccattttttgtacaataccctggaaggaatacgaagtgaggccttgaccctgggagttgacagcatcgcagaaatgacggaggcccttgccacctttttccgctataccatttccaatgtggaccatctggtgaacttggaagatgaacttgcaaatattgaaaactattattatatccagcagttccgtttcggaaaaaaattgcagttaagcattcagtatgccttttcagaggagctggatgaaatggaaatcctgcagtaccgcctgccaaagctgacccttcagcctgtggttgaaaactctattttccatgggatcgaacggaaaataggagagggccacctgatcattaaaatttcggtgacggattcccggttgatcatcaaggtttctgatgacgggcttggtatggaggcagaccgggtgaaaatgctgaacgaaaagcttaaaagcctatccttagatgacgtaaatcctgatacggaccggagaggcggcattgcaattcagaatgtgaacaacagaatcaagctgctttttggagaagaatatggcatccacgtctacagccaggtggaagcggggacagatgtggagatatcccttcccattgtaaaggattgatgacagagaggtgatgaaatgagaaaggaagttctccggctgaatcatgttaccctggaagaaaacggggagcgttatctggataatctggatttttatattctccagggagaaattatggggttcatcatttctgatgcaaaaggctgtacccagctgattcgtctcatctgccataacattcccattaactttggcggagtctattatgaaggaaaccgtgtgaaccattattcccattcggacttcacggacaaccgggtctatgtgattgaggagaggggaaggctcattgacagcctgaccatatccgataacttatttgttatgcgaaagggatttaaaaagtatatcatcaacagcaaagtgctggatcatcaggtggagcttttgatgggatccctggggctgaccattgaccctaagcgccgggtctccaccttaagcgcttttgaacggtgtgtgacggagcttttaaaagccattctggcagggtgccagttcatcatcctggaccggatcagcaatttcttaagccagatggaactaaagcagtttcaggacattatccgggagcaggcaaagcggggatcgcattcctttatatgggaaaccatcatcaggaggtgttccagatcgcagacagggcagccctttttcatcaggggtccatttggaaggttttcgagaaggaagaaatggtggaaacggctcttcagccctataccatatcctttgatttatccggcagtcagatcagggagccaaaggaggaagctgctcttaaactggaaggggttcatttaaacgggaaagagctggttggtttttctcttagaaaaggggaatgtctgatgatactggacacggataatcagacctgggagcctttggtggaggttctttccggcagcagggggatcagcggaggcaggatctgtctgggagaaaggttgtttgcaggagaggagcctgtggacttttttaaggaaggggtggctgttattcccgatgatccggcagaaaccttcctgtttcgggatatgagctacatggaaaacctgacttttcttttagacagaaaagtcaggttcgggaatttaagacggggccatcttcgcagcgtacggaaagagtatatgaaaaaggttggtccttgcattgacgcggtgaagattgatcatttaagccttcgggaaaaatacgggctggcttattaccggatccatctgcttcatcctaaggtcgttgtgtgcgtccagcctttggctaagggagatatgtacttaaggcggtatgtgcttgatctgatccaggagctgaaaaacagcgggatatcggtgctcattctgaccagcaaccttgctgacaacatggatgtatcggatcggatgataattctccaggatggaaaggctgcggcagagtacccaaaagaggaattttataaagtgggctggtgacggaaggaaaaaacaggcagcttgtctgcctgtttttcgtttctgcaaaatttgattgccaaagattgccccccttaaacgaaagaatctcccctactatcccgccgcttccaatgctatactggttacagaagcttacagcagctgaattgtgacgaatttgagagaagtatgagggtgagagttatgcaggaagatattgtgcggatgcagaatattacaaaaacattccctggtgtaaaagcgcttgacgatgtttctttttacttaaaatcaggagaagttatggcattgttaggtgaaaacggcgcgggaaaatcaacgcttgtgaaaatattaagcggcgtctacccaagggatgggggaccatagaggtgttcggcagccatatccgggaaatgaccacgcagagagcaaaggaactgggaatcgcgatcatccatcaggaactgaacatgtgccagcatctgaccgtagcagaaaatattttcctggggcgggagcggacgaaggggatggttctttctgaaaaagagatgaacaaggcggcggctgaaattctcagccgtatgaatattgaattagaccctgaggagctggtaggaaacttagcagtgtccaagcagcaaatggtggagatcgccaaggccctttccatgaatgccaggatcctgatcatggatgaacccacatcagccctgacatcaaaggagatcaatgatctgttcaccatcatcagaaagcttaaaaaggaaggctgcggaatcgtatacatatctcaccgcctggaagagctgaagcatattgtggaccgggtcaccgtcatgagagacggtaaatttatcacatcaatggattttgaccagaatcggatggaagagatcatctcccatatggtaggacgtgaaataaaacagaaattcccccgggtgacctgccaaaaagggaagaagatcctggaggtgcgtcatctaaatgcagggcatctggtgcgggacatcagtctggagcttcacgaaggcgagatcgtaggtattgccggattaatgggagcaggaagaacagagaccaccagagccatattcggagcggatccaaaggaatcaggacagatctttctggatggagaagaagttgtcattcataaggtggaggattccataaaagctggcatcgtgctggctcctgaggacagaaaaaaggatggcctctgcacaaagctcagcatacgggataacattgctcttcccaacctggatattctatgcggaaagctggggatcgtaaacaggaaaaaagaaagggaaatgacggataaaacagtggtttccttaaaaatcaagctgcctaacacagaggtggatgccggaagcttatcaggcggaaaccagcaaaaggtggtggtaggtaaatggctggcaaggaactcacgggtggtgattttcgatgaaccaaccagaggcattgacgtggcggcaaaggtagagatctataacctgatgaatgaattaaagcaaaaggggatcggcgttttgttcgtttcatcggaaatgccggaagtactgggcatcagcgaccggatcattgtcatgtgcgacgggaagattacagggcaaatgaaaacagctgaggcaacacaggatctgatccttaaatatgcgactcagtttgaaagtaagatcagctaagagaagggcaaggagaggtaacatgaatagtaaaagacagagttggtataaaaggctgttcgccgttcgcgggatgggacaggtagtcaccgttggcattggactcatcgtcatgtgcattgtttttggcatcataaaccctacatttttttccgggaaaaatgttgcaaaccttttacgccagattgcaccgattctgttaatcggcatcggccagtcctatgtgttgatcaccggaaacattgacttatccattggttctgtggttggcatgagctgtatgatatccgccaccatgatgacaaaaggaatgaatccatgggcagcggtaatcctcaccctcatgtgctgtctgatcgtaggagttgtcaacggccttctggtagcgaaatgcaagcttccgccctttatcgcaaccttgggcaccatgacaatcgcaagaggtattgcccaaatcgtcaataacaactataatacagacgccatcggagacggggcaaagggttttcgggatttcttttattacggaaaggttgccggagtatataatacggtgatcatatccattgttttatggctgatatttaatttcttattgagtaaaaccaggacagggcggcacatttatgcaatcggcagcaacatagaggcctccaagctatccggagtaaatatcgtatcaaccaccacaaaggcttatctggtcagctccttttgttcctgcatcgtaggactggtgatctgtgcaaccagcggcatgggcaccatggatgcgggcaatgcctatgaaatgtatgctgtagctgcttccgtaatcggaggagtctcaactctgggaggccagggaatcctcattggcacggtgatcggcgcttccatctggggagtgcttcagaacggacttcagtttgcaggagcaccggttgctatccggaatattgtcatcggcgccattgtggtgatctccgtattgatcgatgtgatcgtaagaagcggaaagcttggaaagaaaagtaagcaagaaacgtaaacaaggtattggagcctgaggctttaatataggtaaattttaaaatatccaaatttaaggaggaaaaggtttatgaaacggaaggtattggcggctgttctttctattggaatgattgcgtccatgtgcgcaggctgcagcagcgggcagaaggaggccgcagctacaactggtgcaacaactgcagcagcgactgaagcagcaacggctgcagcaggagaaacagcgaaagaggcagcttcaggggcggctcgtacaaggtttacttaattaccatggaccagatggaccagcactgggtaaacgtagatgcaggtgcccagaaagcggtaaaggagcttgggaatgtagattataaatggctggctcctgatgtgaaggatgatgcaaagcagatcgaatgcattaacaatgccgtcgcaggcggcgctcaggccatattgctggcggctaatggccctgatgcagttactgcatctctacaggaagccattgacgcaggtgtaaaggtagtatacgtagactccgcagcatccctgccggcgatccagacccttgcaacggataataaggctgcaggaaaaactgcaggagaagaaatgatcaaagccttaaaagacaaaggaattgaatccggtaagatcggtatcgtcaatgtcaatgcggcaactgcatccacagtagccagggaagaaggcttccgctctgcatttgagggaaccaagtttgagattctggaaacccagtacggtgaaggcgatgcggcaaaatccaaggatattgcggcaaactatatcactcagggctgtgtaggcatcttcggagccaatgaaggctctactgttggagccggcaatgccattcaggaggcgggcgagaccgtcatcggcgtgggctttgacaaatccgacatgatccttcagctgatcaaggatggctatcttctggcaaccatggctcagaaccctgacgttatgggatatgagggagtgaagacggcggttaatgctctggagagcaaggataccggcgacaagaacgtggacacaggagtttccgttcttacaaaagacaccataaaataacctggagttaaacgcaaagaacgatttcataacaggaatagagcagggccggcatgccggttcctgctctgttgtggtatttcatgataaaaaaaggactgaggtattacgatgcatgtagtagggtttgatattggaggaacaaagtgtgcagtgctgctttgccgcttggagggagaaactgttgtgtggaatgaccgggtggaaatacagacaacgcctgactggaaaggagttttagatgacttatgccgtcacgcagagcggatgcttgagacccatgggattaaccgggcggactgccggatcggaatctcctgcggaggccccttaagtcctgaccgtatggtcatatgttccccgcccaaccttcccgggtgggtttcggtccctgttgtggcctatttgtcggaaaagcttcaaatgactgccaggatgttaaatgacgccgatgcctgcgcccttgccgaatggaagtatggggcaggaaagggatctcttcatatgatatttcttacctttggcaccggtcttggcgcaggacttattttaaacgggcgtctatatacgggagcctgcggcatggcaggagaagttggccacgtccgcctaaaggaggaagggccggtgggatacggaaaagcgggaagcctggaaggcttttgcagcggcggcgggatccgtcagatggcagtaaaaaaggcggagcagatggaaaaggagggaaaaagagcctcattccagacgggagaaaaaggatcggttaaagccaaggatgtggcagaggcagccagagcaggccatgaggacgctgcagaattattaagagagtccggaacatattttggaaaggggctgtccatacttatcgatatcctgaatccggaagtgattgtggcaggaagcatatatgccaggagtcatgagtttctggaaacagccatgtgggaggagatccataaggaggctcttgccccttcggctgcagcctgcaggatcgtgcctgctcagctgggggaaaagataggagattatggggccgttatggctgcggtttatgaataatggagatatgggatttttttgaaaaagaacggtgacaatagagacggaacgtggtaaaatagcccttgcgcttcttaaaaaggcgacaaaattttttggcaggggatggaaaaaaatggaaactgatatgacaagaggcaatccgcttccgatcattttaaaattcacgcttccgcttctgatgggaaatatctttcagcagctttataacatggcagataccattattgtaggccgttttgtagggccggatgccctggcagccgttggctccacaggcaccattatgtttctggtcattggattttcccaggggatgagcaccggatttacggttcttaccagccagaggttcggagcaggggatgaaaacggggcaaagcgttccgtagctaacgggatcatcctgtcatcgtttgttattgcagtaatgacggttttaagccttgcattcatgaaaacacttttacgggtcatgaatacgcctgagaatatttttgaggatgcatacacctatatctccatcatctgcatgggaattgttacgaatgtattttacaatctgttttcatcctatctccgttctgttggaaacagccggattccccttgtgttcctgatgttttctgcctgtttgaatgtagttctggatcttgtttttatcattaactttaaaatgggagtggcaggagcagcatgggccacgaacctttcacaggggatatcagcggttctctgtatttcctatatttataaaaaggtgccggtcttaactccaaagagccagcactggaagctgaacgaggcagatacaaggcgccagctttctgtggggatccctatggctcttcagtttgggatcacggcctcaggaaccattatcatgcagtcagcagtcaatctgttcggttcaaccgcagtagctgcctatacggccgccaataagtttcagggcatggtccttcagggaatggttgccatgggtcagacaatggccacgtattccggccaaaattacggaaagggagatataaaaaggatccgccgcggcgttaagcttgtgctggggacagagatcgtctattcggctctttcttctgtcatcgtctgcctgatcctaccctatgcattaaagctgtttttctcgggagatgtggatataacggagatgctcccatgggccaaaacctatatttacctgtgtgccattttttatattcccttgggaatgatctttatattcagaaataccatgcagggatgcggctatggttttcttcccatgctgggaggcgttgtggagcttgcggcaagattgataactgcggcattggctatccggtttttaagttatccattggcaagcgcctgtgatccggcagcctgggccagcgccggactgtttacggcaatctcatatgtctacatcatgaaaaaggttgagaaaaacagggaaaacagcggttctgtatgatcttttaaatttcttaatttattgttgatttatataataatatttagtatattatgtaatagattatcttaggcggtatacgaaaggagaatcacgatgataaaagtagctgtagacgctatgggcggtgactatgcaccgatagaaatggttgccggagccgtagaggctgtaaatgcgaataaagaaatccaggttctcttagtagggcaggagcatattgtatcggaagagctgaaaaagcatacgtatccaaaagaacagatacaggttgtgaatgcgtcagaggtaatcgagacggaagaacctccggtgaacgccatacgaaagaagaaagattcttccgtcgtagtgggaatgaatctggtaaaacaaaaggaggcggatgcgtttgtatcggccggcagctctggtgccatactggttggcggacaggtgattgtcggacggataaaaggggtggaacgaccaccgctggctccgcttattcctacggataaaggtgtttccctgctgattgactgcggagccaatgtggatgcaagaccgtcccatctggtacagtttgccagaatggggtccctttacatggaacatgtagtgggggtgaagaatccaagagtggctatcgtcaatatcggcgcagaagaagaaaagggaaatgcgcttgtaaaggagacctttccgctgttaaaggagtgcaaggatatccattttaccggaagcattgaagccagagagattccacgcggcggcgcagatgtcattgtttgtgaggcatttgtaggcaatgtaatcctgaagctttacgaaggagtaggcgcaaccttaataaacaaggtgaaaagcggtatgatgggaagtttaaggagcaaaatcggagctctgcttgtaaagccagctttgaaggaaagcctaaagtcgtttgacgcatctcagcacgggggagcgccgcttctgggacttaatggcctggtagtaaagacacatggtaattcaaaggcgacagaagtgaagaactccatacttcaatgcgtaaccttcaaagaacagggaattaatgataagataagagaaagtcttagaaaaagtgaagaaacgcccttagggtatacctttatgcccaaaagcatgggcaggactaaggaacgcccttcgggcatacctttatgcccaaaaagcatgggcggaaataaggaaatcaagaataggagagaggaaggaaaagaaatggaatttgaaaagctacagaacataattgcagaggtattaaatattgagccggatgaggtgaccatgaactccacatttgtggatgaccttggcgctgactcccttgatgtgttccagattatcatgggcattgaggaggaatttgatattgaaattccgacagaagtggcagaaaacatcgtaagtgtcagcgacgcagtagaacagatcaagaatgctttaaattaatagatgtgggtgctgccggggacttttaagtctgtccgcagcaccttctttcataatgagagagaggtgtataatgagcaggaatttaaaagaactggaggaacggatcggctaccgtttttcggacaggcatctcatgacacaggccatgactcacagctcctatgccaatgagcaccggttaaataagctggaatgcaacgagcgcctggaatttttgggggactccgtgctggaggtggtttccagtgactgcctgtatcacaaatatccggagagaccggagggggatttgactaagatacgcgccagtattgtatgcgagccgactcttgcctattgcgcggagtgcataaagcttggggaatacttacttttgggcaagggagaagaggccacaggaggcagggggcgtgcgtcgatcgtgtctgatgctatggaagcgctgataggggccatttatctggacggtggttttgctaatgcaaaagagtttatccttcgtttcattatgaatgatctggaacataagcagctcttttatgatagcaagactatcttgcaggagatcgtacagagtaaaacggacgaacctttaagctatgagcttttgcgggaagaagggccggatcacaacaaggtatttgaagcccaggtcctcataggccaggagataatcggacagggaaccggacggactaaaaaggctgcggagcaggtggctgcttatcatgggatcttaagccttaagaatggagaagggtatgtatttaaaaagtattgaaatccagggttttaaatcttttgccaataagatcgtctttgaatttcataacggaattaccggtatcgtgggtcctaacggcagcggcaagagcaatgttgccgatgccgtgcgctgggtccttggtgagcagaaagtaaagcagctccgaagctccaacatgcaggatgtgattttttcgggaacagaactgagaaaacctcagggctttgcctacgttgcaattacccttgataattctgaccatcacctgaccattgattacgaccaggtaacggtttcccgaagagtttaccgttccggcgaaagcgagtacatgatcaatggcagtgcctgccgtttaaaggatatttatgaattgttctatgatacgggaatcggaaaagaaggttattccattatcggacagggacagattgataagattttaagcggaaagccggaagagcgaagggaattatttgacgaggctgccggtattgttaaatttaaacggcgcaagctcattgcccagaaaaagctggaagatgaaaaacagaatctcatccgtgtgagtgacatcctcactgagcttgaaaagcaggtagggccccttgcaaggcagtccgaggcggcaaaggagtatctccgactgaaggaagatttaaagaaatacgacgtgaaccagttcctgatggaaacagaagggattcaggttcagatgaaggaaaaccgggaaaaggaaaatatcgtatcccttgatctggaagatgcaaaacaggcatcagaagggatccgggaagaatatgacattctggatacatatctggcggagctggagaggtcagccggcgcggccagaaatgagaagaataaatccaacgtggagatgggaagcctggaaggccggatcaatgtattaaaggaacagattaatacagagcagatgaacgccgaacacattgccggacgggtgagggccatccatggggagatccagatgaaaatggctcaggcggcctcctatgaggaagaacggtccctgattgccggccaggtaaaaaccgcagtaacagagcttagagatgcggaagagaccttaagttcagaggacgagaaaatccgccttttggaacagcagattgaagagggcaagggaggcattattgacatcctcaatgaaaaagcttctctgactgcaaaacagcagcggtatgaaaccatgctggaacaggtgaatatgcgccgttccgaggtctgccaaaagcttttaaaattcaaaagtgatgagtcggagcaggatgaacagctgacggctcttcaaaaagaagcagatgagatcgaggccggaattgccgagggccagaaggcccagtcccttagtgaaggaaaggcagaagagctggaaggcgaggtcaaaaggcttaataagaatttaaatgataagcagcaggaataccataccagttatacaaagctggagtccttaagaaacattgccgaacggtacgaaggctatggcggcagcatccgccggattatggaggtaagagaccgggtccacggcatccatggagttgtggcggatttattcacagtgccgaaaaaatatgagatcgccattgagaccgctcttggaggcagcattcagaatatcgttactgattctgaggccactgcaaaacatctgattgaatatttaaagaaaaaccgatatggaagggccaccttccttccattgaccagcattgcaggcagggattccttccgccaggaccgggcgctgacggagccgggagtcttagggcttgccaatacccttgtggaagctgacggccggtatgaaggccttttaaactatctgctgggccgtgtggttgtagtggataccattgaccatgccatcgcccttgcaaagaagttccagtattctttcaggatcgtaaccctggaaggagagcttttaagcgtaggcggttccatgacaggaggcgcatttaagaatacaagcaatttactgggacggaaacgggagatggaggaactggaagggatctgcaccaaagctctttctgatgtggaacgcctggaaacagagctggtaatgaacgagggactccttgcagaatgcagggaggaactggaaaagatccgttcagaaaaacagcagctttatttaaagcaaaatacggttaaaataaatatacgccgtattgaggataaaaaagaggaaatcaaggaatcctacggagatctggagcgggaaaacggtcagctggaagtgcagatccgggagatcggcgccagccagcaggagcttctttctgcggttgataagctggaaaatcagaatcaggatacggtagaagaactggagcgtttaaacggacgtctggaaaaagccaggtcagacagggagcagtattccaaagatttgtcatctgtccagttaaaagcctcagttctaaagcaaaaggatgattttgaacaggaaaatatccggcgtgtaaaagaagaaattcaccgtttggaagaggagcttggcgggctttcaaacggtaccgacggttccaactccatcattgaagagaaacagaaagaaattgaaagcttaaagggccggattcaggaagaactggtacgctcagaagaactggaaggggtcattaacgaaaagtccgcacaaaaagaggccagttccagggagcagaaggaattattccgaaagagggaagagcttaccggaagaatcagccttttggataaagaattgttccgcttacaaagccagaaggaaaagctggatgagtggatggagagtcatgtcaattatatgtggaatgaatacgaactgacctattccactgcaaacgacttaagaaatgaagagtggacgtcactgccggagatcaaacgcatgatccagtctttaaaagaggacatccgcaagcttggcaacgtcaatgtcaatgccatcgaagattataaagaggtatcagagcgctacaccttcatgaagacccagcacgatgaccttgtggcagccgaagccactctgctaaagatcattgatgaactggatacgggaatgagaaaacagttcgaagaaaagttccgtgaaatacgtatggagtttgacaaggtatttaaggagcttttcggaggaggacggggaactttggaattagtggaggatgaggatattctggaggcgggaatccagatcatatctcagcccccaggcaaaaagcttcagaatatgatgcagctttccggcggggaaaaggcattaacagccattgcattgctgtttgccattcagaacttaaagccctctccattttgtcttctcgatgagattgaggcagccctggacgattccaatgtggaccgttttgcaaaatatttgcataaactgacaaaatctactcagttcattgtcatcacacacaggcgtggtacaatgatttctgcagaccgtttgtatggtattaccatgcaggagaagggcgtttcaacccttgtatctgtaaatctgattgaagaaaatttagaaagttaaggagaccgactatgggtgagaaaaagggattctttgggaagctggttgctggactgcagaagacaagggataatattattgcaggcgtggattccattttcagcgggttttcagccattgatgatgagttttatgaagagattgaagagatcctgatcatgggggacttaggtatccagaccaccatgtccatcatggaggatttgagaaagaaggtaaaggaacaaaacatcaaggatccgttagaatgcaaacagctcctcatggacagcatcatggaacagatggacttaggggaaaatgcctatgaatttgaaacacagcggtctgttcttttgattattggcgtcaatggagtgggaaagaccacttcagtgggtaagctggccggtcagatgaaggatgatggaaaaaaggtcattgtagctgcagcggatacctttcgtgctgcagccattgaacagctgagtgagtgggcaaaaagggcaggagtggatattatcgcccagcaggaaggctctgaccctgcggcagttgtttatgatgcagttgccgcggcaaaatcaagacatgcggatattttgatctgcgataccgcaggccgccttcataacaagaaaaacttaatggaagagcttaagaaaatcaaccggatcattgacaaggaatatccggaagcttaccgggagactctggtagtgttggacggcacaacaggacagaacgctcttgtacaggcaaagcagtttatggaggttgctgatattaccggcatcattctcacaaagcttgacggaaccgcaaaagggggaattgcggtggcgatccagtcagagctgggaattccggtcaaatacattggggtaggagagaaaattgatgacctgcagaaattcaatgcaaaagaatttgtaagcgcattgtttcacgtagaagagaaagaagaggcgtaaatatgatgacactggaaaagtttgaagaagcaacggaagtcgttagcaaggttatcctggaaacaaagctgatatacagtgagtattattccaaccagaccggcaataaggtatatttcaagccggagaatatgcagtataccggcgcctacaaggtgaggggagcttattataaaatcagcaccctttcccaggaggagaaggcaaagggccttattaccgcctccgcaggaaatcatgcccagggtgttgcctatgcggcaaagctggcgggaattccggccacaatcgtcatgcctaccacaacgccccttatgaaggtcaaccgaaccaaaagctatggcgcggaggtgatactggagggagatgtatttgatgaggcatgtgattacgccaacaagctttccgaggaaaagggactgacctttgttcatcccttcaatgatctggacattgcggccggacagggaaccattgccatggagatcgtgaaggagctccctacggttgattacattctggttccaatcggcggcggcggtttgtgcaccggagtttccgttttagccaaaatgctcaatcccaagatcaaggtcatcggcgtggagcctgcaggcgccaactgcatgcaggaatctctgcgccagggaaaggtggtggaactgcccagtgtcaataccattgccgacggaacagcagtcaaatgtccgggagacaaactttttccctatattcaggaaaatgtagatgaaatcattaccattgaggactctgagctgatcgtagcatttctggatatggtagaaaaccataagatgatcgtggaaaattccgggcttttgacagttgcggctttaaaacacatgaatgtggagaataaaaagatggtttccatattaagcggaggaaatatggatgtgatcaccatggcctccatcgttcagcacggactgatccagagagaccgtatctttaccgtatccattcttctgccggataaaccaggagagcttgcaaaggtatccgctctccttgcaaaagaacagggtaatgtcatccgcctggagcacaatcagtttatcagcatcaaccggaatgcggcggtggagcttcgcatcactctggaagcctttggaaccgatcataagaatgccattatggctgcgctcacagctcagggttacaggccaaagctggtgaagtcaaaaggaacttatgcggattaaaaatccggactgttgaaaggcagtttttctcatcagccgttatagaagatgggaatccatatacaaagtaaaagcacgggattttaccgtgcttttatctatttatgagatgttgcctgattccagatattcaaatgcaattcttggactgccgttttccgcatatatggtcccgcattttacaaacccattcttttgaatcagatacttcataatctcattattttcatgggtatctattctgagatgagagctttgtcttttacaatagtccaggcattttgaaagtatgccttttattgctccgtcactggcgacccggtgaatggcaccgtaacctgtgtcagatatccaggagccgttttcaatatggctgtaagtaggatcatctcccaggataaaagcaaatacaccatgtatctgttcctcattgatataaacatatagctggttatttttaatatcctcttcaagcaattctgcaggagggaaggtatttccccattgcgaggcgtttccgttatcaaccataaacttccttgcaatctcatatactttcaagattgccggcaaatcctgtattttcgcatttcttatcatataaattcctcctaaatcctgatctaagcagacaggaatccattgtaacaaattttcacttaaggaaccaaagaaattataatattttcctgctatcattaacgattgatttttcggacaatctccataagccttggaagacaatggtcaaaaaaaatctgataggatcggcagaagtaattgcggccggattcttccggggacatgatgcggtggcggtagcagcctcctctgcacagtggaaaataggaacaggcctggcactggctgtcaggcgcttttttggaagcaagaaagcctgtttccaacctctttttgtgtatttcatcaaaacccgtattgtttaaattgcccagcttatattcgtccagaacaaagaagtcacagggatatacctcgccgtcagcttcgatgatgttttgaatgctgcataacccgttcatgtcacaggattccgcacttccggtcaatataatggagaggtaattataaaactgccggatgtagatttcgtttccggcaattatatcctcataccacaaatcaaagaggtcacacaggaactgtccgtataattccgacgtcagggaatattccatggcgcctgcgggagcctccaaaggatccagacaggggatgaactgcagataacgaaagcccatcttcttataataccggtatatcttgccgatggaggaagcggttctcctgtttactacggtgagaatgttgtattccactccatgctcattgaagctgtccacagtcttcatgatatttaaaaacgtatcgctgccgtcaccgcctttccggtaagcatcatgggtatgtatggtcccgtcgatggagattcctatcagaaaatgttctctggcgaaaaattccgcccattccgggcctaaattatagccgttggtctgaagggcgaaatgtaattccagattttttttattatattcctttgaaagccttacagcctgttcaaaaaaggggagtccggccagagtgggttcccctccctgaaaggcgatagtacaggcagtatctgcgtaatccagggccttttttatgacatttcttaaagtttccacggacatgagaccataagagctttgtgttcttttttccgtaatatcatggtaaaagcaataatggcatctcatgttgcacatgccggaggccggtttgatcaaaagattaactggaggcatggatttaactcccttcatctgtgtacggataaatgatccggttttcatgttccctgggtgatatgcctgtaacctttttaaataccttgctgaaataataggggttatcaaagcccagcttatcagaaatttcatacatcaggtactggtgggtatcaataagctccatggcgtgctgtatcttcacctgtgcaatataatcagacagggtggtccctgtcagctttttaaaggtattgcttaaatggccagagcttatgtttaaggcttccgcaacatcggccagggtcagcttttccatatagtgctctttgatatagcttctggctaagtccaccagtttgtcggaacgggtggatttcctgtcgtccaaaagccggcaaagcttctggcagaagcttctcagccattccaggatgtcctctaagctgttaaaatgattcagctgctcggcaatgttgatggtgtaagggaaaatgtcctggtagctgtcatccctgtttcaaaaaatgaatagagataggtgtaaatgttgatgcaggcgctggtagcctgttccttgcggggcttgttttcccagaacagggtgatgatgtcttcaaaaatggaggccagcttttcactgtcgttctgactgatataagctgccagatcctttttaaatacattaatgttaaatttctttgcctggctgaaatgggaggcctgcccctggtaaaataccacctgggaggaagagtcaaagtagtaatattccagtgctgttaaggcttcggaaaacgcctccaaaagctctgaaatcttttccttcggcctgctgaccccataaacggcggaaagctcaaaataagtttttaaagcaacgctgaacttctggcaaaactccctgacagagctttgagaaaatgcttcctcttttaaggaagcagtaatgagaaaggtatcctgccggtattcaaggatcgtataatgaaagaaaaatcttgctgcgatcccgcccaggatatcgatcagctgcctgctgacggaatgcaggtcatagcttcctcctccagcttcaaagtctatattaataggatttaaggaaaacaggatgataaaaggagccggatattgcacttcaagctcctccggaatatcagcaagctcttcctgagaaaggaaaaggcggcgaaacgtcgtctttgccaagtcctcctggttgtttttaagctgaccgcccgccatctggtgctgcttattgataagcaggtcacaggcttccttggcccgctctaaagcggttattaaggcctcttcgtttaaatcgatttttaccagatagtcagaggcacccagtgatagagcttttttcaccagatggaattcctctaagtttgtcaatacgataaaagcaaaagtgcagccgttttccttgcatttttccaccagatccagcccgtttaatacgggcatccggatatccgttataacaatatccggatgaagctccatgatcatgtcataggctgaagggccgttggttgcctttccgataatggtgcattcataattttcccatatgatcagggaagcgatgccggccaggatgagcggctcatcgtctataataataattcgatacatactgttttaatacccctttgtcagccctttctaaaattccagaggaagggcaatggtaatcaatgtatattgatctaattcgctttccagctttaatccgtattcttctccataaaccagttttaatctcctgtccacgtttggaagcccgattccgctcatgttgcttctggtgatgcgggaggtatccgtcaggagcctttccatgttttccggagaaatgccgatgccattgtcctttactgtaatataaaggacgccgttttcggcaaaaacgtgtatctgtatgagcccgtttcttccgcttggctcgatcccgttaaagatggcgttttctacaatgggctgaagcgtcagcttcacgattttggcatcgtataaaacctcctggtcaacctgggttgttacatcaaagagttcaatatatcggattttctctataataacataattctgcagaaaatccaattcctgacggagagttactttttcgttgaagccttttgccatatttttcagcagggaggacaaggcggtgaccacctggacgatcccgctgtttttctgcatggttgcaatccatttgatggaatctaaggtgttataaagaaaatgaggattgatctgggcctgtagcattttgatttccagatcctttttttctttttcgctttgaacccttgtttccataaggttggagatccggttggacatctggttgatctgttttcctatgcttccgatctcgtcgtctgtttcaatggaacggtccgggtcgaagtttccctggaaatgaactccagacgttttttcaagcggctgatgggagcgcttaactggcgggatatgaaccaggacaaagtcaggccaatggcaaagcagaaaaagaatatgagtccaatggtgcctccgatcactccgtgatccaggtttaagtctgaaatcggaaggacctgaaagaaaatcagcccgctgactgcttgtctttcataggcaatgatgcattcctttccatccagccaggtgcggaaattgccctgggggtctttaaagtcttttaaagtggccagcaaaaggtcaacgtcaaaagaatccccattcacagaggaaataatacttccatccgaagtggccgcgtaaagaatctgaccatccccatgcttttcagtgtgtcggaaaacaggcggggagaaatagccagaaagatccaggcatcttccggctggccgctggaagcatattttaatggtcttaaaagaggaagaagctttggagtataattcgtaggagaaaaagggttgtcctccagagaaagaaggtactgggtattttctctggaaagcaaatcatgaaaccagggggcattttgaatgtcaccggcatcccgggtggacccgtaagcattaccggcctgtaaaacttccccattattataaagtgtgattttataaatatatttgctgtagcctgatatggcgcagaaatctctcagcacattggaggcatacagcttaatataggtagattcaccgtagtctgacagtcttaaagaggcagaagaaaataaagattttcgttcggaacaggtcacaacaatgttgaccatttcttcataggctacttccatacgatctgagagaatctgaatccggttgacggtattttccgtttcattttcaacagcatccttataataagagtgatagttataaaaactaacagcacaggcaatgcttataaccaccagaagattatacaaaagaaatttatactggaatgtgcggggcatggcatgatcctttctgaaccccgtgagcagtcgcaaaagccaggtaagcttaactttggctcattgccttcacgagaataaattcagtaatatcatatcctttattccatagaaattcaatgaaatagaaattaatcttaaaaaagtataaaaatctgaataaaatatatgtttggaagcgtgaaaacatgggaagcgtaaaaaaaataatagaattatgcaaatcgtttattccgctataacctcaaatctggtatctttatatcataaagaacacgcgcgtagttctaaaaaaagggaggtttcaaaccgatgagattaaaaagagttttatctatggtgttagcagccggaatggtatgcacatcattgactgcatgtggcagcaaggcaactgaaagcagtgctgcagatacagctggaacatctgctgcagaatcaacgaaagcagacgaaaaagcacaggattcaggcgagaagaaggttctttccgttacaacatgggattatgattcatcaccacagttccaggcagtcgttgatgcctatatgaaagaaaatccaaatgtggagatcaaggtaattgacacatcagctgacgaatacaacaattccttaggaatcagcttgtccgcggctcagccggatccggatatcatttgggtaaaggatatgggctccatgcttcagatggctgataaaaagcagcttcttcctcttgatgatttcatgaaaaaagataactttgatacatccgtttacaatggtgcggcagagcagcttcagtacaacggagtgacctacggacttccgtaccgttccgactggtatgtattatattacaataaggatctttttgacgcagcaggcgttgaatatccttccaatgatatgacatgggaagagtatgatgcactggctgcaaagatgacttccggcgaaggcagctcaaaggtatatggcggacataaccatacctggcaggctcttgtaacaaactgggccgttcaggatggcaagcacacagttgttgaaaaggattattccttcttaaagccatggtatgaatcagctgttgccttacaggataatggatatatccaggattactctactttaaagacagcaaacatccattactcttctgtatttaagaatcagcagtgtgctatgatgccgatgggtacctggtttattgcaaccatgatccagtcccgcgcagcagatgagacttcctttaactggggcattgcaagaattcctcatcctgctgacacagaagccggttatacggtaggtgctcttactcctctcggaatcagcgcttataccgacgagcctgacttatcctgggattttgtgaagtttgcaaccagcaaagaagcagcaaatattctggctgaacagggcgtatttaccggtatccagacagaggaatctttaaagaccatcgcttctgcagagttcttcccagagggagagtcaaatattgaagcactgtcttatactcactacacatttgaccgtcctttagatccacagatcgaagaaatccgtaaggtgctcgatgaagttcatgaaatgatcatgatcaagcagtacacggttgatcagggaatcgaagagctgaacaaacgtgttgcagaaatcaaaggctggtaaaatataattgattgcccggagagcgccttttctaaaacaacagcaaggcgctctttttgtggcaaaaagcaggtgaaaaggaggttaaccctgtatgaaggaagtaaaaacgacattgacgtcgcatcaaaagaaggcaatccgaagtaacctgatcggttattcatttattctgcctaatttaatcgggtatgctattttcgtattcattcccgtcatcttttcctttattttaagtgttatgaaatgggatggttcccaggctcccatggagttcgtaggattaaaaaattttgctcagattttcggtgacaggatatttgttcaatcctttattcacaccattcaatatgcattgcttacggtattcccaaccttagtgctggcgcttttactggcagttctgttgaatcataaattaaaggggatcgcgatattccgtaccgcgctgtatttcccttatattgcttccatcgtggcagtaggtgcggtatggaacatgctgtttcagccggattttggaccgatcaatgaatttttgaaattcatcggcatttccaagcctcccagatgggttgttgatgtgaaatgggctatggtggccatttccgtggtaagtgtatggaaatacatgggatactatatgatcgtgtatctggcggcccttcagggaatctcaggttctctttatgaagcggccggtatagatggggccaatggctttcagaagcttcggtatattaccattcccatgctgacaccgaccacattctttgtgctgatcatgcttacgatccagtgctttaaggtgtttgaccttgtatatgtaatgacaggcggaggtcccggcaacgccaccaagaccctggtcaattacatttatgaaaaggcatttacctcatggcagttcggaccggcaagtgcgggagccattgttctgtttgcagtagtgcttgtgatcaccctgattcagtttgcgggtgaaaagaagtggtctaaggatttgatgtaaggagggaaagcgatgaaaacaaaaacaaaggatttaaggatacttctgtatctgggattgattgctttatccctttttatgctggtgcccttttactggatggtaatttcttctttaaagcttaataaagatgtattttccataccaatgaaatggtggcccgatacgttgcattgggagaactacaaaatcatctggaagaagctgccccttgtgaccttctttttcaataccgccaagcttacggtcattacgaccatcatccagctgtgcaccagctgctttgctgcttacggttttacaaagacgcgttttaaaggcagggacttgattttccttatgtatgttactacaatagctgttccatggcaggtctacatggttccccagtttattctggtttccaagctgggccttaacgacactcatttaggattgatcctgatgcaggccttctccgccttcggcgtatttttgatccgtcagttttatatcagcattccggatgaattatgcgaagcagccaggatcgacgggttaaacgaatacggcatattcggaaagatcgtgttccctcttggaaagccggcaatggcgaccttgaccatctttacattcaccaatgtatggaatgatttcatgggaccgctcatctatttaaagacaaaagaattaaaaaccatccagctgggtatccggatgttcatatcccagttcggagctgactatgcatggatcatggcggcctccgtatgctcattggtcccggttatcatcgtatttttaagctgtcagaagttctttgtagagggcgttgcagccagcggaatcaaaggataacaggaaaggagaggcatatggcacagacattggaacaaataaaaacctatcctggaatggaagagggtatggttcaaaaagctcttgacgatgcggtgaagctcgttaaggagaacctttcggaatttacggataaattccagtcttccaacagctttgacggattttatgaggcaacagaaaatgtggaatggacaacaggattctggacaggagtgatctggctggcttacgagcacaccggtgatgaagcattccggaaagccgctgaagtacaggtagaaagcttcctgaacagaattgaaaataaaattgacgtaaaccatcatgatatgggatttttatacagcttatcctgtgtggcagcttataagctgaccggcaatgaacatgcaaaaaaggcggctttattggcggctgatcatttggcagaacgctacagggagagaggcaagttccttcaggcctggggaaatccgggggaacctaaggaataccggctgatcattgactgcctgttaaatcttcccttactttactgggcaacggaagtgacaggagatccatcgtatgaagaaaaggcggagaaccatataaaaactgccatgaaatgcattttgcgcccggatcattctacctaccatacccatttctttgatgtggaaacaggggaacccacctatggagtaacccaccaggggaaccgcaacggttctgcatgggcaagaggtcaggcctgggggatttatggaatcgccttaagctaccggtatttgaaaaatccggagtacacggacttattctgtagtgtgactgattattttattgagcatctgccggaagatctggttccttactgggattttgactttgacacaggaagcacggagccgagagattcctccgcatctgccattgccatctgcggaatcctggaaatggcgaaatatctggaaaaagagaaggcacaggtatatttggctgcggctgaccggatgcttaaggcgctgacagatctttgtgccaacagggatttcaaaaaatccaatggattgctgcttcacggcacctatgcaagggattccaaagagaatacctgtaccaaccgtggtgtagatgagtgcaatacatggggtgactatttttacatggaggctcttaccaggctttccaaggactgggagctgtactggtaagtgctggtggaagaataaggagaaaaaagaatgaaaacaaatctgctgtatgtatttgccgaccagtggcgggcacacgccatgggattcatgaacatggaccaggtggtgactccaaacattgactcttttgcccgggagagcatgaggtttaccaatgcttacagcacgtacccattatgctctccccacagagcgtctctgatgacagggaaatatcccttccgcgcaggaatgtggactaattgcaagattggactggaagaaaaggtcatgctgaggccccaggagatctgcatcggagatgtgctgaaggatgagagataccggacgggctacattggcaaatggcatctggatgcttcagagcttaattttacttccaatccaaaatcaggcgcgcgggactgggatgcttatacgcctccaggggaaagaaggcatggatttgattactggctgtcttacggagcctgggatgatcacctggatccccattattggcaggatgatgaaaaacagataaagccgggaaaatggtcagcagaatttgaaacagacaaggccattgaatacatggaagcaaggaaagaggatgaacagccgtttgcactgtttctatcctacaatccgccccaccttccctatgaactggtgccggaccggtattatgagaagtttcagggtctggaggtctgctatcgtgaaaacgttcctgaagagatgagggaaaagggaggacttctggaaacccagacaaaacagtattatgctgcgatttatggaattgatgagcagtttggaagaatccttcaatatttaaaggatcataatatggaggagaataccattgtcatcttgtctgcagaccacggggaaatgcttggctctcatggattgatgagtaaaaacatctggtatgaggaatccctccatatcccgctcatgattcgccagaaggggagaatcgaggctgtggacaatgacgggatatttgccagtcctgatcacatgccaactattctggagcttctggaaattcccgtaccaaagacatgtgagggatatagccatgtcaaaggcatgttcggaaaggatgagaatgagcctcaggatatgctgatctgttcttatccgggaggtgcggagatggtaaaggctttttctgataaaggtctcagccataaggcttacggatggaggggtattaaagacaaacgctatacctatgtcatttccaacggctatgctccgggagaggagcaaaaggaatatctttatgataatctggaggatccttatcagattaatccacaagtattggagccggagtgccaaagagcggatattttggtgtaccgggaaaagctgaaaaactatctgagtctgacggacgatccgtttttgtgggaacgatagaagattaatgaaataggaggtagccgagcatctcggccgcctcctatttcgctatagatggatgaaaactgtttaaagctttctgaactttaccaagcatacgtatggatacggaataagtttctttgttatccatgagaagcaaagcgttatctctggaatattttaatacatgctttagatttacgatggtagaacggttgcattggcagaaaccagaatttaaggtcacatggaattcttttaacgagcctgaaatctgccggactccggttttagtatgtactataagcttatggggatcgtcgccggttgtaatggcgacaatatcattttgatccagaattaaggaatctttatcaacctttatggataagaggcggttggaggaatccagctgcgccttataatttctttcaacgttctgaatacaagaacatatttgctggggtaaggtatccgattcatctttaataataaaatccattgcttcaactttgtagcgaaaggtaagaacagccatttcactgtgagtagttacgaaaacgatataaccgcgagggtcatattttcgtatctcctgggccagttcaattccatttttatttgactgcaaatcaatgtccaaaaaataaagtccggtagtgcttgatcttctccgcatggaaagcaactcttccggttttgaggcggaacagtaaagcttggcttccgttgggttcatcaataaatatttttctataatgtctacccagcgatttaattgtcttttatcatcttcacaaagatatatgtggatcatttttgtactccttattattcgttatgcattaggattagttcttgtgtgaaataaggttcttcatatgtagtattccaaacaacatttttatagccttttagaatcatatccacgttaaaaaggccgattcctctattttctccttttgttgaaacgttatggtttcgaagttctgatatggcataatctggaggaagggccgtgttttgaataatgagatagagatccatctccttataaaacatgcaaaaatgcactttcttttcttctgtctccatagcagcttccatggcattgtctaaaaatatgccgatgatcctggatagatccaggcaatctatggtaagttcgtcgattgactcagtcaattctatttctattttgatacctacctccatcatatagacgaatttagaggagagcaggctttttaaggcggtgtttttaatattggagagaattcccagcttggtgtctgattctgtaaatgcacggctgatggggaggattctatcactgtaatattcctttaggccatccatatcattttctttcataaatccagacattgtaataagtatattcatatagtcatgcttgaatttacgcataattccgtaggaattttccaaacgttccgtgtaggtgcgaaggttttcaaattgtgccatacgatgtttgtaagcttgttcgcccattgtgactttataaacagaatacatgagaaagactgtgactgtaaacaataataaaaaaatgattccatttaatgcaataacaccgtaattatatccaaggcgctctccataagaaaagttgaaaatgtaaaagagcaccaagagaaaaagattaataaaaatagcttttagcatatggtggttggttaaatattttgttatatttaattttttatgaatataatgaccaattagttttgttgtagttccacagaataaacaataaatgcaagaaaaaatgataagcaaaaaatggtgagttattaaagcctccatatccattttaaatatgaaaccggctccccacataaacaaatagttaaatgtaattgtataaagatagccaaataaataacaggataggctcaaatagtgattactagtaaaaagataaattataagtgtgagccctgaaaaggtaatgaatgtgctggcttgtccgaaaattcggttaaaaagaaaagcggtgccaaaagtatataaaaataaaataaaccgcctaagaattgtcaacttattagggagtaagtgcacacaaaaaaagtaaacacataaggcccctgtaaatgtataaataaaataagtcatgatgtatctccttgccagtagatgtatgtatatattttaccttgttataaatggaaagtaaagaaaattgtatgaaaagtagatgcattttacgcttaggaagaaatatactacggaaactacaaaaatattttgttggcataaatatatgctagtatatggtcaaatggtggtgataaaatgagtatttccaaagttgctgtcggtttttgcgattggttgaatacaataagtcctagaagtccagaagaaaataaggtaattcaatatggggtggaattgttgttggacaatattattaagcttattgttatcgtgcttattggaattgtcctgggaaaagggtttgagaccgttgtggtgttatctgcattttgtgccttgagattacaggctggtggtattcacgctaaaacaggtttgggctgtggatttagtgtgttgttagtttgggcaatatctattttaggtgatacatattttgatataaaaacgtcatttttgccttgtatctatatagtttctgttcttgttgttatttgctgtgttcctagaactataaatattaagtactttagtgtacaagacaaattaagaaagaagttatattcaattgttgttttaacattaatgatgacaattgcatttttaagtccatttttaagagggctgattatttatcctgttattttggaagtattaactctgcttcctaaaagtaaagtaaatgtaaaaggagagaattgatgatgaaaaaatggctgcagaagaattacaaaaagcattagtaaaagtgtccctaaattcagtagggagaagcattccggctttaatttatgaaagaaaaattccggaagcagtgttaaagatgcgtaatgagaatacaaagtaagaaattagtgagggaaagaattttggcttttaatttaagttcaaacagtccggtatgagttctataatgacaatgtggtaattatagaaagaaaaagcgcctttatgcccatgaaaataatgtatataaattttatgggattttcaattccaactagttggagtgtgtataatatgattactgtagtaacaagggggaaacttttgcctggattaattatgattcctataaaaagttaaatgaatatatggaatttgttctcattcagaagttttatggatactcagtaaaataaggttaaaataatttctgccctttgaattaattcaaagggcagttagttaattgaatggaactggctggatactttttagactgttctatatgtatagtgtcagcgtgcatctttctatacaaggggatgacaaaataggagataaggcagatgaaaaataatacatttcgaaaatttttaagactgaaaaagaatttatcgactgatcctatgcaaaagagtgccatgtcaaaacacagaaagagaaagatcattccggatgaatattttattgatgtgataactactataccagaaagaaatgctgtgatggtgaatattgatttttaaccaggataggtagttaacggaatattggtaaaagcagttctgtatggctcctataatgcaattattatggaaaggaaaagtaccactatgccaaaaacacaaatataaatttattgtaaggtttttaaattcggtaattggaatttgttttcattcaaaggttttatagttactcagttgaaaccagataaaaatagtaattactggctttcgaatcacttccgataggcagctatgtttataagtaagataatcgatgccagtatttcaaagacggccagtggttacacggaaaatttctggaaatatttcagcttcattaaaatgggactagtatctgaactggtttttcaagcttttacggaaaagtgtaggagtgaatacgcatgaaaataaatttatttcaaaaaattcttagattggaaaagaatatagcagatgcttatctacgaaagagcattatgtctaagtacagaagtagaaaaatcatcccagacgaatactttattgatgtgataacaaccataccggaaagaaaagccgtggtggagagtagtgatatttaactagagaaagcagctgatataatgttaatatagacaagtatcgaataggaaatgtctcaaagattgtgaacaccttcaaactgatgtaagtagggtagaattactcagtgtgggggtttttatttctatagggctctaagtagtgagataagagtaaatctttctgcttccttagattatgagaaatgcctaattttttaaaagtccattctttattgaattgttataatatgtcagataaatatacatatatctaccagtaaggagttacatcatgaattattttttttatattttttcgggaaccttatgccattactttttttgtacatatttacttccggataacttgacaattatgaaacgacttgttatatttttatatacttttagtacactttttctttttactcgaagctatggacagaccagtacgtttatctcctttgggggaaccatgcttttgttatattttttacacataatcgttacttaagtctatcctgttatttatttggctatctttatggaattacattcaactatctgtttttattgttggtttatttcatctttaaaatagatatgaagacactaattgcacgtaatttgtctcctataattttttcttgtatttattgtatgttttgcggaatcactactaaattaattggttattacattcatgaaaagctaaatattgctaagtatttaacaaatcacactttactaaaagctatttttgtttatcttcttttattaatgcttttttatatatttaacttttcatatggagaacgccttggctatactcatgacgtcattgcattaaatggaattattttcttagtgctatttgttatcacagtgtttcgtttgcattcaatctataaaatcttaagcgcaaaataggtcctttccaatagttgccttttcaacaaagtctgaaaagatgaatatacttatggggtgggttcttccacgattatccgtttagcatttcttttaaccgtcattttagtgctcaatattttttcagttaaatcaaactcctgagcaagtgaagtatgtccttttaaataaaattataataatagtattcgacaagaatctatatattttacattaatttaaatggaaaataaaggaaattgtgtaaaaagaacacaacaaacatataaataaacaaattatacattcaatgaaagaagccaaaaaccaagaagaggaatcagatgaaacttggcatacccgaatattttgcacaccaagcggctaatagtcgaagaaaacactggtatgtatcgggaatgggtgctgtcaacagagcactaacaaaagaaagactgataatcagtggcttttatgacttagccacagcttatcagtctgcgcacatcaactattgaaagcaccgtgtaccgaatggtacgcacggtgctgtgagaggacggcggttagtcaccgcctcctgctcgattaatcatatcttaaaatttacttacattcttccaaaagcatcttcggctcagcaaccatggaataattggtgtgatagataacaaagccaggcgcagctccggccaccttcttaatctgctttttctgaacataatccacttccaccttatcattttcacggcctttggaatagtaggcggctaaggcagcggcttcttcaaaagtcttgtcaggaagttccctcccttccgattttacgatcacatgggatccagggattcctttggcatggaaccaccagtcgctgttgccagccaccttaaaagtcagttcttcattctggtaattatttttccctacataaatatgaaatccgtcggaagatagatagtggaagggcttgcttgtgatctttggcttcttgtcgccggaccggcgatgcttaatataaccgtattccatcagttcttccttgatctgtacaagatcctcttccattaaggcgatatccaaagcagcacttacggattccagatgatcgatttcctgttttgtttcagcgatttgttccgttacggcctcaaaggtgcgctttagcttgttgtatttatcaaaatatttctgtgcattttcctttgcagacagctggtcatccaaaggaattgaaatatcctcattggtgtaataattaaggcagacaagctgcttttcctctccggtcaattcatatccataggtattgataagctcgccgtaaaccttatacttgtcccgtttgtccgtatccttcagctgtttggcctgtaagtcgaattttttataattccgctccaaagcggtctgtacgattttccgtaaatccacggatttttgccggattctggtgatggtgttttttgaagcataataggtttccaatagtgcgctgatggaatcaaagcactgggaaacataaccttccccctggtaacaggttaaggggagagcggagaattccacaggttcctcttttttatatatgatattgggagtaaagtgcctttgtcttacatcttctattataaaggaaaacatgtgatataaatgaatcagttccaactcagacaatccgtttgcagaccggtctccgtcaatggaagccaggaagcagagctcatggcccatgatggggcttataccggtcagtctcatatacagcgccttttgtatgggggcggccgtatgcccgatcacatcaatgaattcttcctgagtcacggtcaaagggtcttttttctccattgtctgagggatgaaataggttcttcccggcaaaacttcccgcacagagctgacctgggctgaaatatgcttgatgctgtctaaaattaagtcctcttcattgcaaaaaatgatgttactgtgctttcccatgatttcaatgatcagttttttaatcctcttgtcacctagttcatcgaaatgctccacttccatgcacaaaatccgctccagccccggctggctcacccggataatgcgcccgtttccaatatgttttctcaaaagcatacaaaaatttggggcggtcatgggactctgcttgtttgcttctgtaaaatagatgagtgggagactggcgctggccgagattaagagtctccatgtatttttctggtttttaactgtaaacagcagttcatctttttccggctgggcaatttttgcgatttttccgccttccagccggtctttcatctctgctgcgagatttgccataacaattccgtctaatgccattttctgtttcctctttcctgcccacgccatttgggcataatggttccctggaagggttttcctctttcctgccacgctatctgggcataatggtatccctggaaagggtttccttcggtaaatggtctttacaatagggatagtatagcacagaatcatgtttctgtaaaattcaaaagcaattgacttgttttttattatgacttataatggatgatatctatggcgaaagagaggcatatggaatgatcaagagcatgacaggtttcggcagatgcgaaaccgtcacggatgaatataagatttccgtagagatgaaggctgtaaatcacagatatttggatttaagcataaagatgccgaaaaagtttaatttctttgaagcagggatcaggaatctgttaaagaattatatccagcgtggaaaggttgatgtatttatcagctatgaggattacacagagaataagctgtgtttaaagtataacagcgcgctggctgccgaatatatggattatttcgcaaagatggaggcacagttcgggattcagaacgacatcaaggtatcggccctgtccagatgcccggaggtccttaccatggaagaggtgccggaggatgaggaacaaatgtggaagcttctttcggaaaccattgaggaagctgcaaaacgttttgtggaaaccagaatgactgaaggagaaaacttaaagaacgatcttcttggaaagcttaaatttatgactgagcttgtggaatttattgaagaacgttcccccaggatccttttagaatacaggacaaagctggaggacaaggtaaaggaactgctggcaagcgcttccgttgacgaaggaaggattgccacggaggttacgatttttgctgataaaatctgtgtggatgaagagaccgtgcggctcagaaaccacattgaaaatacctgtgcagagcttaacgcaggcggaagcgtgggaagaaagctggatttcatcgctcaggagatgaaccgggaggcaaataccattctttccaaagccaatgacctggagatttccgataaggccatcgcactgaagaccgagattgaaaaagtaagggaacaaatccagaatattgagtaggagagaaacgaagaacatgaatgaacatggcatattggcagtcgtatccggattttcaggggccggcaagggaaccttgatgaaggagcttctgaaacggtatgataattacgcactgtccatttccgccaccaccagaaatcccagagagggagaggaacacggcagggaatatttctttgtgacagaagaacgttttaaggatatgatggtaaaggaagaattgatcgaatatgcccagtacgtcaaccattactatggcactcccaaggaatatgttttgaaccagatgaaaatgggaaggatgtaatcctggaaattgagattcagggagcacttaaggtaaagcaacatttccctgctgcgattttgattttcgtcatgcctcccaatgcagaggaattaaagcgccgtctcatcggcaggggtacggaaaacatggatgtgattaatgccaggctccgccgggcggctgaggaagcagaaggcatggaggcctatgattatatccttattaatgataaaatagacacttgtgtggaagagatgcaccgcatgatccaggtccagcataaccgggcttccaataatatggcatttttagcccatatcagggaagaattaaaaaatatatagagccgattgagaaaggggaataaatgatgttacatccatcttattcagatttgattaatgtagtaaacagcgaggtagagccaggagaggctcctgttgtacagagccgttattccattgtaattgccgcagctaagagagcaaggcagatcatcggcggctcggagccggagattttgggagccggtaagaaaccgctttctgttgccgtagaggaactgtatgagggcaaagtgaagattttaagcgaagcggatgcaacagaagaagacgataaataggaagaaggccgtctcacttttggatgagatggcctttcccatggaataatctgcttaacaaaggctttggggcttaagttttgttgattagccatttccttttataaagaaagacaggagtttaaatatgaagttattatgtgtttcactaggctgcgacaaaaatctcgtggatacggagatgatgctgggccttctgaataaggacggatatacgtttacagatgatgaatatgaggcggatgtgattgtgatcaacacctgctgctttatcggtgatgcaaaagaagaaagcgtaaacaccatactggatttggcccagagaaaaattgacggcaaatgcaaggcgctgatcgtcaccggctgtctggctcagcggtataaacaggagatcatagacgagattcctgaagtggatggaattctgggaacctctacctatgatgagatatctaacgtcctggcggaagcccttggcggaaaccagcatgttcagcgctttcatgagctggacgagcttcctgaggtggaaacggaacggatccttacaacaggaggccattatgcatttttaaagattgcggaagggtgcgataagcattgcacctactgcatcattccttccctgcggggaattaccgcagcgtacccatggaacggctgataaaggaaggggaacgtctggctgagaagggggtaaaagagcttattttagtagctcaggagacgactctttacggcgtagacctatatggagaaaaatcacttccaaagcttcttaaaagcctatgccgcatatccgggatccagtggatcaggattcagtactgttatccggaagagattacggatgagctgattcagaccataaaggaagaagagaagatatgcaattaccttgatctgcctatccagcatgccagcgaccggattttaaaacgcatgggacggagaacttctaaggcccagcttcaggaaatcgtggaaaagctcaggaaagaaatcccggatatggcgctgagaaccacgttgatctcaggatttccgggagaaacacaggaagatcatgaagaactgatggaattcgtagatgagatggaattccagcgtttaggcgtgtttgtatattccgcagaagaagatactcctgctgctgagtttccggatcaggttgaacagcaggtaaaggaagaacgccgggatgccattatggagcttcagcaggaaatctcttttgatttttccaagtccatgatcggaaaaaccctggaggtcatgattgaaggcaaggtagcggatgaaaacgcttatgtaggccgtacctatatggacgggcccggtgtggatggaatgatttttgttcagacaggggaagaactgatgtcaggtgattttgccagtgtccgtgtcacaggggccatggaatatgatttgataggagagttggaggatgaatttaccgaataagcttacgattttaagggttattatgattccgttttttgttctgtttctgctgcttgacggaggtgtcaatgccacataccgttacattgcagccgttatattcattgcggccagctttacggactttctggatgggaagatcgccagaacgtatggcctggtgacgaatttcggcaagtttatggatcctctggcggataaactgctggtctgtgcaggactgatctgttttacggctcttggccagctttctgcctggatcgttatcgtgatcataagccgcgaatttattatcagcggtttccgtctggttgcctcggataatggtgtggtgattgcggcaagctactggggaaagtttaagacggtttcccagatgatcatgtcggttcttcttatcctgaacattccggcattgtcctttgttacaattgtgtttatctggatcgccgccatccttacagtggtatcactggttgattatatagcaaaaaattatcgtgttcttatggaagggagtatgtgatcatggttgtagaactgatttcggttggaacggagcttcttcttggaaatattgtaaataccaacactcagtacctggcggaaaaatgtgctcttttgggactttccatgtatcatcaggttacagttggtgataacagagaaaggctttcggaaagcctggagactgccttaaagcgttctgatgttgtcattttgaccggcggcctggggcctacggaggatgatttgacaaaagaggtctgtgcagaagtcatgggcttttctttggtggaggatgcccatacaagggacagaatcaaggcatattttaaaaacagcatttataaagagattccgggcaataactggaaacaggctcttgttccccagggagcggttgtgcttgataatgataatggtacggctcccggacttattttggaaaaagatggaaaagccgcaattttactgccgggacctcctaatgaattaaagcctctgttccaggaccaggtatttccctatctgcagaaacgtcagccagaagtgatccgctctcagatgatcaaaatctgcggccatggcgagagccaggtagaggataagattctcgatctcattgacggtcagtccaatccaaccattgccacctatgcaaagacagctgaagtgcacttaagggtcacagcaaaggcgtcagatgaagaggaggcaaaaggtcttttaaagccggtggtaaaggagatcaaaaaccgttttggggatgatgtatataccacaaaagaggaagagaccattgagatggcggttgtccgtctccttaaaaaatatgaactgacggtgaccacagcggaatcctgcacagggggcctgattgcagggcgtctggtaaacgtaccgggagcttcccaggtgtttcgggaaggctttatcacttattccaacaagtcaaagagaaagcttcttgatgtgagcaaaagtactttgaaaaaacacggtgcggtcagcgaacagactgcaaaggaaatggctatcggaggtgtttttgctgccgatgctgatgtctgtattgcggtgacaggaatcgcaggaccggattcggaaggggaaaagccggtaggccttgtttatatggcctgttatatgaaagataaggtttcagtggaagaatatcactttaaggggaaccgggaaaagatcagggaacagtccgtggtaaaggctctggatttactgcgccgttccattctcaagaattatcattgataaaaccttccgggaggagagaaatatggatacccgtttgctcaaaaaacagatgactgcagcgtaccagtactcctatgtaaggctggtgctgaattattatactttatttgaaaccataggagacgagccggtgatttcccaacagatcatttcctattgcctgcagctaagcgggctgcttaaggagcatttttccgggaaggatacagaggaagagcttcttaagctccgggagaacattactcatgaagtggaagtactgacttcctatacggactgctttcagatttatgaatatgttctaaaccgcatggaacgaaagtttcggttactgccggaaacagggcttgatgatgaaagctttgcaaaacgtcttacaggatttgtgacggatactaaggaaactgccgttatgaacggaaggatcaaacagatcatcggacagcttccggtccgtctgaccaaacagaagtttttcagtcttgttatggaaggactatctgtttacatcggttctcccagggaaaatcttcaggatatgatgtatacccttcgcacggaatccatgacaaagcttccttttggaatggaagaagggcataaggacctttttgagcttttggaacaattccgccatactgattataaggcaatgactgctgaaggatatgaagaagccgctgcaaagcttgctcttgcatgtgaagggcttatggatgaatccgggctttatatcatgcttcaggacattatcaatgatttttgtgttctggtttttgccaggtcggaagcggtcattgatgtgaaggaggaggagctttatgcctccatggcaggggagattctggaaaaattcagcaaagaggattattcccccgtaaaagacggtttttttgacaggctcacccagctggagggaagacaggaagcttattatgaacgctatttaagggcagaactgccggaagagagcgacgaatggaatattgatcctgattatgtaaaggcagtcaatgtggacaggcttttatcaggaagcagtttcgtggaattaaagaaaacaggccaaaaggatggatcggctgttgttgaccgttcttgtctggaagaaacggcaggggagtattttagggaactggaagaggtattctcctatgttcccaggcctgtggcccgggccataatggccaaggtcttatcagaccttcctgtctacttcaattctattgatgatatacagacatatattgaaggcagtcttaaaagctgcctggacgaagcagaaaaggaaacttgcaaggaattattggaagagctgatggattatgaaaataagctggtatgaccgtttgtacgcaggagaaaaagcgaagaagaaacgttaccggatcattcaggggatccgtaagtcaaagcctggcaccgggatttatgtgattacgcctgctgcaaatggaataatatacttgatatctatccggcaacgacgcttttatggcctctttaccgggaagaggagtttctcattctgggcattgcgtccggttactgggaggcgttagaggtagccgggaatatcgtcagtgatatgtaccggaaaacaggaggcttcgatctgcctgcatttatagggaacgaggccggtaaggtgtgaggtgttcatgcttcatataattttgtttatacttaagatcttagggctgctggtgctcattgttttagggcttatccttactgtggttctgctgattttcctggttcctgtccggtatcaggcagagggatcctatgacgggaaggtgaagggaaaggccagaatcacctggctgctacatatcctttccgtaagggttcaatacgagggagacgtgctggcgacggtccgctttttcggcttccgtattggaaagccaaagaagctggactcggagcttaaggaggcggaagagatcatggttcacgccatggaagtagtggaaccggaagccgtaaaagaagtacgggaagtaaaagatgagattcgtgacaaggtcaaagaagaatcccaaaatcttccccctccaaagacagaaccaaaggcagcagcaaaagaaaagcccaggaaaaagccagaggaaaagcctgatgagaaaaagagattctgggtgccgaagttattggaaaagcttaaaaagaaggtttttgttgcgtatgcaaaacttaagttttttttccggcggatctgtgatacactgaaaactgtaaaagataaaaaggatgagattcatgccttgatttccgataaggataaccagagaacagtaaagctgctttttaggcagggaaaaaaactgctccgccatatccttccccgtaaaggaaagggaaacataacctttggctttgatgatccatatttaaccggtcaggtgcttacctatgcaagcgttgtttatccgctgtgccataagcatttgaacctgtatccggtgtttgaccgggaggtttttacagcggaaggaacgtttcagggcaggattcgaatggggacggttctttttattggatccaggatgctgtttgataagaattttaggcgtttgttaaagaaatggcttcgataaaggtgtctgcagctctgatattttgctgcgctgattgaagctattgcgtggtttgaaacgataaaggaggaattgcttaacgtggcagagaattattttacatctacggtagaatcgctgtttaagggtatggattcttttgtggcgacaaaaaccgtggtaggagatgcagtaaaggtggatgataccatcatcctgcctttggtggatgttacctgcggcatggctgccggatcctttgcggaaaatgcaaaacagaacggggccggaggcatgcatgcaaagatgagccccagtgcggtgctgatcattcagaatggagtgactaagctggtaaatatcaaacagcaggatgctgtgacgaaaattttggacatggttcctgattttgtcaataaatttgccggcggttccaaagaggtttctccggaagccttaaaagtggcggaggagatggccgctgcagaagagaagaaaaaagcggaagaataagaaggggataagcagcataggatgtcatatagcctgaatggattgagggatgatatgagaagagtatgcggacttatgctgttctgcttcggagcgggtatggcgatcctgctttttatcccggcgactatcgttacgatcctgtttattatcggatgtctggtactgggatataacctgttctgctgctgatcaagcaatgctgttaaaataaatggggcctttttaggaaggccccatgaaaagaacaaaaaaatactcctgactgatatcagccaggagtttccttcgattaagctctttcaactaatccggatcttaagcaggaagtacatacgtacatcttcttagcgccgccgttaacttttactttaacggacttcacatttgctttccacatcttgttggatcttctatgggaatggctcactgcgttgccaaagtgagcagctttttcacaaattgcacatttagccatgattgcacctccttaaaagtaacttggattttttatgattgaaaaatccacaacaaatgtatgataacagaaaaaccatggatttgcaagtgaaaaataaaaatttgtttctttttttggaaaaatcatgtataatcaaataagacagaaagaacggaggtagagactatgaagggttatattaataataaactgggcgagatccaggtgagccctgatgttatcgctatgtatgccggaacgactgcagtagaatgcttcggtattgtcggtatggcggctgtcagcatgaaagacggtcttgttaagcttttaaagagagaaggcctgactcacggaatcaatgtgaacatccaggacaaccatattaccattgatttccatgttattgtagcttatggggtcagtatttctgcagtggcagataacttgattgaaaatgtaaaatacaaagtagaagaattcaccggtatgacggtagataagattaacatctttgtcgaaggcgtaagagtgattgattaaggaggaaactacctgtgggtatgaagtatatagacgccaaaatgctgcagaaggcatttctggcaggagcaaaaggactggaagcgaagaaggagtggattaacgaactgaacgtgtttccagttccggatggggataccggaaccaacatgaccatgacgatcatggcggcggctaaggaagtggctgccattgagaatcctaccatggaagccttggctaaggcgatttcctccggttctttaagaggagcaagaggaaactccggcgtaatcctgtcccagttgttccggggattcacaaaagagattgccactgtggaacaggtgacagctactgttttggcaaattcctttgtaagggcaacagaaactgcatataaagcggttatgaagcccaaagagggaaccattcttaccgtagccagaggcatggctgaaaaggctgccgaactggttacagagacagaggatatccttgaattctgccagacggtgatcgatcacggtgattacgtattgagtcagactccggaaatgcttcccgtattaaagcaggcgggagtggtggattccggcggacaggggcttatgcaggtcatgaagggagctcttgactgccttatgggcaaggaagtggatgtatccgtagagggaataaaacggccggatatcattgcaggagcccatggagcaaagactgatgacattgatattaaattcggttattgcacggaatttatcatcaatctggaaaaacattatgatgataaagcggagcatgaattcaaggtttatttagaatccataggtgattcccttgtggttgtttcagatgatgacatggtgaaggtccacgtccataccaatgaccctgggcttgctatccagaaggcacttacttacggctctttatcccgtatgaagatcgataatatgagggaagagcaccaggaaaagctgatcaaggaatcggaaaagcttgcggcacagcagaaagctgaggaagaaaaaaaggcggagaagagaaaatcctatggttttatttccgtatctgccggggaaggccttgacggaatattccgggggatcggagccgattatctgatccagggcggccagaccatgaaccccagtaccgaggacatgttaaatgctatcgaccgggtgaatgcagataccatttacattctgccgaacaataaaaatattatattggctgccgaacaggcgaaaagcctggtggaggacaagaaggtcattgtgatcccttccaaaaccataccgcagggcatcaccgccatcattaattttgcgccggatctgtctccagaggacaatgaaaagatcatgacagaggagatgagccgtgtgaaaaccggacaggtcacctatgcggtccgcaataccatgattgatgatattgagatcaaggaaggggacatcatggctctgggggacaatggaatcctggcggttggaaagaacatagagcctacggttctggaagctttagaggccatggtggaagaggaatctgaattggtgaccgtttattacggcaaggatgtcaaggaagaggatgcaaaaacgcttaaggaaaaagcagaagaattgttttcccactgcgaggtagagcttcatgcagggggccagccgatttattattatctcatatccgtagaataaaaagggccagcggcattttttataccgggcagatggagtcctgtctgcccggttttgctatgcaggaaacaaagaaaggagggagcctgtctttgaaccgagagtcaattgattccttaaagggaatcggagaaaaaacaggaaaattgtttcaaaaggtgggagtgatcactgttggggaccttttagagtattatccgagggcttatgacacctatgaggagccttctcccattggggagctgaaaccggatcaggtgatgactgtggccggaatgctttataagactccggatgtaaaacggtacagccacatccaggtcatcacaacgactttaaaggatatgacaggtacccttttgcttacctggtacaatatgccttatcttcattccaccttaaaagcagggatgcgggctgttttccgaggccgtgtggtgaagaaaaacggccgcttaaccatggagcagcctgaggtatttacggcagaggcttatgatcaggtggtccattccatgcagcctgtttacggccagaccaagggactgagcaataaaaccattgtcagggcccagaagcaggccttaagccaaagaagcatggtacgggattatatgcctgctgatttgcgcaaaaagcatgaactggcggaatataattttgctattgaacatattcattttccgacggaccggagcgagctgttatttgccagaaaaagactggtgtttgatgagtttttcctttttctcatggcagtccggcgtttaagggagcgaagagaggataagaaaagcgcatatgtcctgagtctgtccccggaggtagaggccttaagaaaaagccttccctattcccttaccggtgcccagcaaaaggttttaaatgagatatacggcgatttatctggggggcgggtcatgaaccgcttaatccagggagatgtaggctccggcaagacgattattgccatcctctcccttttacaggcagcgtataacggatatcagggagcgcttatggctcctacggaagtgctggcaaagcagcatcttgaatccatgacagagctgtttgcagcccatcagatcgataaaaagcccatacttgttacaggctccatgactgcaaaggaaaaaaggattgcctatgaaaagatcgctttccatgaagcagatatcattatcggcactcatgccctcattcaggagaaggtggtatacgacaatctggcgctggtaattaccgatgaacagcaccggttcggagtcagccagcgggaaatgctgggaaaaaagggagaagagcctcatgtgctggtaatgagcgccacgccaatccccagaactttagccatcatcatttacggggatctggacatttctgtcattgatgagctgcctgccaaccgtctgcccattaaaaactgtgttgtggatacaggatacaggaaaaaagcctatgaatttatcaggaaagaggtgacagatgggcgccaggcctatgtgatctgtcccatggtagaggccagtgagatgattgatgcggaaaatgtgctggattatacgaaaaccctgcgggaggcgcttccgggaatttcggtggagtatcttcacgggaaaatgaaaccaaaggaaaaaaacgggatcatggagaggtttgtcggcggggatatcaagatcctggtttccaccactgttatcgaggtaggggtgaatgttcccaatgcaacggttatgatgattgaaaatgcggaacgcttcggcctggcccagcttcaccagttaagggggcgggtggggcgggggaaacaccagtcttactgcattatggtaggaacctccgatcaggaggggacgaaagaacgcctggatattttaaaccagtccaacgatggtttttttatcgcctcagaggatttaaagcttcggggaccaggtgatattttcggcatcaggcagagcggggatttggaatttaaactgggggatatttttacagatgcaaacctgttaaagactgtatcagaggaagtgaagcgactttttgaggaggatcctgagctggaaaaagagaaacatcaggaactcaaggaaaaattgaaagagtatcttgaaaaaagctatgataagcttaatttgtagcgaaagttttccgatttcatgattttgcagtaaataattgcaattattggcaaaaactgataaaattatcatcgtaaaaccaatcgcagcaaggaaacaggaggaattatatgagtagagaagctttaaaaatggatgcaaaggctgccatgagagaggcgcttgtaagtccttatatggtaacaataattttaggagttattacgatcgtattctccgccgtacagggatttctggacatatgggaaggcatgatagaaaatgccggcgcttatggggacataggtcagagcggagcatttgcggtaagcagcattattttcatgattgtttattttattgttagcaccattatccagtttgggtatcagtcttactgtttaaaggttgcaaacagggatcaaactatgtcatatggagatctgtttggttccgtaagatatttattgaaagccatggggctggttttgatgatgtctctgcttactatattatggtcgctgcttctcatcattccgggaattattgctgcctaccgttattcacaggccattattattatggttgaggatccggataaaggcgtgatgcagtgcatacgggaaagcaaggaaatgatggcaggtcataaatgggaattttttgttctggaactgtcctttattttatggcagcttttaggccttgtcacatgcggtctggctttcatttatgtatatccttatacaaaggttactttagctaattattataatgaaataaagccaaaaacggttgtatatgaggaatcgtacatgtttgagtaaacagtccaaagggttcaattctttttaagaaattgaacccttggattatttatgaagatttacagcatatgccgcaaataaatggaggagcacggaagatgaattgtgtgttaattggaattgccggagggaccggttcggggaagtctacctttaccaaccggctgaaggctgcgtttggcgatgacattgcggtgatttaccatgataattattataaaaaacaggatgaactttcttttgaagagagaaagaaaatgaattatgaccatcccgaagcttttgaaacagagcttttgctggaacagctccagatgctgcgggatggaaaggcggttgactgccctgtttatgattattccatgcacaaccgttctcagaagcaggtgaaggtggagcctaagaaggttattttggtcgagggaatcctggtttttgcagatgagcgcctaaggagcatgtttgatattaaaatttttgtagaggctgatgccgacgagcgtatccttcgccgcgtaatccgcgacgtaaaagaaagaggccgggatattgagggtgttgtggagcaatatcttactacagtgaaacccatgcactatttgtacgtagagcctacaaaacctctggcggatgtgatcataaacagcggcatgaatgaggttgcgttccagctggtgaaaaccaatattgaaaagatattggagaccggaaatgaggagtaatggaccttctgcatgagaatatttatgaaggctcaatttttttcctgaaaataacattttacgaaaaaccttctagtgtatttcattctattcttgccataataggagtgtagcacaaaacacaccatgaattaaataaaacaaaaacatggtgaatagatgaaaaggaggcatatcattatgtcaggaagatctaatactacaaatgtaccagaggcaaaagaggcaatggatcgttttaaaatggaagttgccaacgaaatcggtgttccgttaaccaacggttataacggtaacttaacatctgcacagaatggttccgtaggcggatatatggtcaagaagatgatcgaagcccaggaaagacagatggcaggcaaataaacctgtaaaaaacaaaaaaacacccttcggaaataaagaacatgtccggtaaacacggataacggaagggaaaccgggagccgcagattcgtaactgacaatcagttatgggagctgcggctccatttttttataaatgcgttgccctgatacgtcaaccacaggacattgaccaggtaaaaacgcaacttttggttgtatatctcacaaattcatactataatatccacgaaagcaatgagcagtgcgaaacaggatgtttaaagagattcgtcgtgcctgcacgtaagaatctctttaaacatcctgtttcatagggcgaacgcccgtgagcgggtgaatcccccggattcacccgctgcactgcggacttataccatagcaaccggtaaaaacaaagtgaggaattctatcatgagagtaatcgcaggaaaagccagaaggcttatattaaaaaccatagagggacaggaaacccggcccacaacagacagaataaaggagacgctttttaatatgattcaaggggacatgcctggccgcagttttctggatctgttttccggaagcggagccatcggaatcgaagcccttagccgtggagccggtctggcagtcatggtagaacaaaatcccaaagctgcggaatgcatccgtgaaaatttaaagaccacaaagctggaggatgacgcaatagtcatgaactgtgacgtcatgacaggactaggcaggctggaaggaaaggggcatgtatttgattatatattcatggaccctccctataataacgactgggaaaaacggattttccagtatctgtccgattccccgctgattcatgaggacacaaccatcatcacggaagcctccttaaacaccccctttgaatatctggatgaaatgggataccagatcattagagaaaaggattataaaacaaacaagcacgtctttgcatcaaggaaaaaatcataacaaatgcccaaaccatacaggcaatcataaagaaaaggaagagaccacatgagaaaagcagtgtatccgggaagctttgatccggtgacttttggtcatctggatattatagaacgttctgccaggatgtcagatcatttaatcataggagttttaaataataattccaaaacgccgttgttttctgtagaagaacgtgttaatatgttaaagagccttactaaagaccttcccaatgtggaggtaaagtcgtttggagggcttttggttgattttgtacgagctaatcaggcggatgcggtcattcgcgggcttcgggctgtaacggattttgaatatgaattgcagatcgcacagacaaaccgggttatggcaccggagattgatactgtgtttttgacgacgaatttaaaatattcttacttgagttccagcattgtgaaggagatagccgcctatggcggagagataaacacgtttgtgcctgcatgtgtcgcgcagcgtgtaatgaagaagatggaagatagaatgaaataagagtaaggagtgttcgtattatgatgagcagaattgaacagttaatcggtgaaattgaagaatatattgacagctgcaagtaccagcctctctccaacagcaagatcgtggttaaccgggatgagctggaagagcttctggtggaacttcgtctgcgcattcccgatgaaatcaagcagtatcagaagattatcagcaaccgtgacgcaattatgaatgaagcccgtcagcaggcggattccattctggcccaggccaatgctcagacaaatgagctggtcaatgagcatgaaatcatgcagaaagcatatgcccaggccaatgatatcattgaacaggccaatcaacaggcccagcagatcgtggaacaggcggtggccgacgccaatggcatcaggcagagttctgttcagtatacggacgacatgttaaaaagtcttcagaccattatcagccattccatggaaggcgcccagggccgttttgacgcttttatgacttccatgcagtcaagctatgatatcgtctcttctaaccgccaggagctgacaggagctgttacgcccgcggcaggaccagaggaaaacgggccaatagaataaaaagtatgatggtaaggaggctgtgaagcactttccaggttacatagtgccggatggataatccggcattttttataacactctttgtctgaaagataccggacaatcctccgaatgcggtcacaaccccgatccataagcctcctgatattcctgaaaaggcctgggaaacggccttgatcccggtggtgatctccacaaaacccaggatgacggctttatattgaggaacatttataggaagttttgttatgtaaagagccaggatggaaaacagcataatatatcctccgatttttaccatgacctcgcaggaatccatcaggctatcgtcaaaggatttataggattctcttgtaacaggcagagatccggccggcccgctgatgccataaaagctccttgctgcaatggaaagagggaatatgggcaggtacacacaggtaaggaggagccagaccggcagtgacggcgggagagctccggcggcataacctaacaggaacatggggctgggatgattgcagatggctaaaaggtatttcccttccttttcggaaatacggttattgtccataaaatcgctgcaggtcctggctcccatgggatatccgcagagaagaccggaaatcagggtatagcttcccgcatcagagaggcaaaagaactggtgcaggatccttcttaccgggaaaataaggatgcggatggcatttaaggccacgatgacattggagcagatcataaagggcagaagggtgggcaccaccacagagccccataaaaccagtccgtttctcgctccttcaaaggctgtagacggaaaacggagcagcaggattaaagcggcaacggaaagcagacggaaaaaggattttttcatgtacacctgaatagattgttttatacaattatatgaaatggcatgactgatatgatggtgattcttcttttcatcctgatcctttccgttttccaggtgaccatgatcgattatctgtacaataatcctacattttaccagctggatgcttatacctgggaaagtgatgatttcaggagcttaaagcttggaaaaatggtggcggaatgggattctcttgattatgatactttgacatccttaatggtggagcaccagtatgatttaactggggtcacagacaaggatacccatacggacagacttttaaaggtaaagccagcggagtaccggaagctccgccaggcctatgaaatacttttaaatgatttgaaatttttccccataccattgaccactctttccggttccccggatataagctatcaaaacggctggatggaagccaggacctatggaggcgaacggggacatgaaggctgcgatattatgggaacagaccagcccagaggacattatccggtggtcagtatgagcgacggggtggtggaaaaggtggggtggctggaaaagggcggctggaggatcgggatacgggctcctaaaggcgcgtatctgtactatgcccatctttacggctacagcagacagtggaaggaaggggacgaagtaaaggcaggggagcttttgggatttatgggggacaccggctacagtcaggtggaggggaccacaggcaatttcccggtccatttgcacgtgggaatttatttgcggaccgaccataatgatgagatgagtgtcaatccctactgggtcttaaaatatctggagaaataccggctgaaatattcgtattagctatatttatgaaaacaaaaagatgacttgccttgcaaatttccgcaagctatattaagattatttccataggcatgatttacttaaggcaggggcacaccctgaattttgcaaaaaagccatccgaggagccaaaggcgaatcgaacttccttgaaacaagatgggagcgacaacgtgaaagaacgaaagatttcggaagaatttttaaacaggatgaaagatttattaggggaagaggagtatgaggcgtacttaaaaagctttgaagaggaacggctttacgggctgcgggtcaatacccttaaaataagccctgacaaatttgcagaaatgacaacccttaagcttaagtccgttccctggatccataacggtttttactatgaaggagaagaacgtccggccaaagatccttactattacgccgggctttattatctccaggaacccagcgccatgacgccggcaagtctgctggacgtggttccgggagacaaggtccttgatctgtgcgcagcgcccggagggaaaagcacggagttgggggcaaagctgaagggtcagggacttttagtgtccaatgacatcagcaattccagggcaaaggcattgcttaagaacttagaattatgggggatcgagaacatttgtgtcaccagcgaggaaccaaagaaattaaaggaagccttcggtgaattttttgataaaatactggttgatgctccctgctcaggagaaggcatgttccgcaaggatgctgatatggtgaaaagctatgaggaacgcgggccggagtattatgcagaaatccaaaaagagatcatggaccaggcggtagacatgctggcggccggcgggcttcttttatattccacctgcacgttttcagtctgtgaaaatgaggatatcatcagccggaccctggaacgccatgaggaaatggagctgatccggcttcctctttttgaaggggcaagcggagggatcggtcttttaagctgtctgcgcctctttccccataagatcagaggagaaggccattttatggcactgctgaaaaagaaaggatctcaggcaggacatgaggtccatggaaataagtccatgaaacagcttcctcttcctcaggagctttctgatttcctttccatggtttcaaaacctctggagagctcccgcatccggataaagaatgatgttgtttactaccttccggaatacttcccggagaatgctaacggccttcgttatctcaggaccggacttttgctgggagaaatgaagaaaggccgttttgaaccggggcaggcctttgccatggcgttaaaaccggaagagttcaaacagaccgtttcctggaaaaagcaggatgagagagtgatccgctatttaaaaggggagaccatctttttaaaggaagaagaggggccgataaaaggctggtgtttagtctgcgtggaaggtattccattgggctttgccaagggaagcggggccgtgctgaaaaataaatactatccgggatggcggtggcagtgatgaaggaactgagacttgataaatatttaacagaaatgggagaaggaacgcgaagccagattaaggaaatggccagaaaaggcaggatttcagtagacggaatccctgagaaaagggcggaacgcaagatccatccggagcagaaccaggtaactgttgatggacgtctggtgtcttatgtccggtatgaatactatatgctgaacaagcctcagggtgtggtatctgccactgaggattcccgttacgaaaccgtgataagtctcataggggatcggaaacgggatgatctttttccggtggggcggctggatattgatacggaaggacttcttctcatcaccaatgacggagatctggcccatcagcttctgtctccgaaaaagcatgtggacaagatttattttgcccggatcgaaggagagcttccggctgacgcaaagaggcggatggaggaagggctggtgctttctgatggtacagttaccatgcctgcttatttgaaagttctggagcagggaaaggaagaagaaccttccgaaatccttctgaccattcgggaaggaaaattccatcaggtgaagcggatgtttgaaactctagggtgccgtgtggtatacttaaagcggatgtccatgggaagccttgcacttgatgaggttttgaagccgggagaataccgcccgctttcagaagaagagatccggaaattaaaaagtcatggtaacgtacgtgggtaagattaaggaaacacccttcgggtatacctttatgcccaaaggacatgggcaagattaaggaaagggagacaaaagcagaggatgttagaggaaaagagagctgttatttttgatctggatgggactttggttgattccatgtggatgtggaaatccattgatatagaatttcttggcagcagaggacttgtttgtccggatgatttgcaaaaagatattgaggggatgagctttacggaaaccgctttttattttaaagagcgtttcagactgaaggaatccttagatgaaatcaagagtgtgtggacggatatgtccattgaaaaataccggaatgaggtctggctaaagccgggagcaggtgaatttctcaaatatattgctgaaatgggattaaaggccggaattgccaccagcaacggaagacagatggtggatgcggtgattgattctttaaatatcgggcaatattttcaagtagtggctacctcctgcgaggtgactgccggaaagcctgcaccggatatctatttaaaggtagcgggagagctttccgtgcctccggctcactgtctggtttttgaggatattcctgccgggatcatggcaggaaaacgggcaggaatgacggtctgtgccattgacgatgaattttccagagagatggaagaggaaaagcggcagctggccgactattttatatacgactatcaccagatactaaatagaaatggagtaaaatcatgatccacgattatcttcccatgggccggtccgatatgaatatcagagggtggaagcaatgtgactttatttatgtcaccggtgatgcctatgtggaccacccgtcctttggccatgccatcatcagccggcttttggaagcccatggatacaaggtgggcattatatcacagccggattggaaagaccgggcaagcatccaggttttaggggagccccgccttggatttctggtttcaggcggcaacatggattccatggtaaatcattactctgtttcaaaaaagcgcagacagcaggatgcttatacgccgggggagttatgggaaagcgccccgattatgctgtcacggtttactgcaatctcatccggtccgtatataaaaaggcgcctgttatcatcggcggcattgaagccagtctaaggcgtctggcccattacgattactggtcggaccggctaaagcattccatcctgatcgattcccaggcggatttaatctcctatgggatgggggaaagatccattgtggaaattgcagatgctttaaacagcgggattgacatcaaggatatcacttttatagacggcactgtttataagacggacagtctggaatccgtatacgatgctctgatcctcccttcttttgaaaagatgaaggctaataaactggaatatgcaaaaagctattacattcagtataacaacacagatccgtttacaggaaaacgcctggcagagccttataaggacaatctgtttgtggttcagaaccctcctgcaaagcctctttccatggaggagatggatgaggtatacgcccttccttatatgaggaattatcatccttcctatgaggagcttgggggagtgcccgccatccgggaaatcaagttcagcctgatcagcaaccgagggtgttttggtgcctgcagcttttgtgcactcactttccatcagggccggatcatacaggccagaagccatgattcccttgtggaagaggcaaggcttttaacggaggagccggactttaagggatatatccatgatgtaggaggacctacggcagattttcggtctccggcctgtgataagcagatgacaaagggagcctgccccaaccggcagtgcctgtttccggagccttgcaagaatttaaaggcggatcacacggactatattgaactgttgagaaaattaagaaacttaccaaaggtaaaaaaggtattcatccgttccggtatccggtttgactatgtgctggccgagcctggtaaaaagttcttaaaggagctttgccagtaccatgtgagcggacaattaaaggttgccccggagcatgttgctgataaggtgctttccaaaatgggcaagcccaggaatcaagtgtaccgccagtttgtaaaggaatataacgatatgaatgggcggcttggcatgaagcagtatcttgtcccttatttaatgtcctcccatccaggttccgggctttcagaagccgttgagcttgcggaatatttacgggatttaggttatatgccggagcaggttcaggacttttacccaacaccttccaccatatccacatgcatgtattataccggatatgatccccgcaccatggaaaaggtgtatgtgccagtcaatccccatgaaaaggcaatgcaaagggctctgatccagtacaggaatccgaaaaactatgaactggtttccgaagccttaaggctggcaggccgtacggatttgatcgggtatgataaaaaatccctgatccgtccgaaaataagtgctccgggaggtttttcagacagcaaagcagggaaaaattacagcagcgggaagaaaacaggagccagggaagcggaaggccgccgggaaccaaagaaaaagaccataaggaacattcataaaaaggcaggaaaaaagtaaaactccttaatttaaccgaatcaagcagcgatagctgctattcggttatgagcaagtagcgaagcggattgcgaatatccgcttgacagaagtactcattgggtatccaaagcgggggagggctctgcccggagcatgaggacaacaataaaagaaaagaaggaattgattatgaagattgccattgtgacaggtgcgtcttccggcatgggaagagagtttattatgcagattgccgaccgtttcagcgggatcggagaaatatgggccattgccaggagaaaagaacggctggaggaattatcccctcttgttcctgtcagggtccggtcctttgccattgacctgacggataaaagccggctgacagatttagaagatctcctgatgaaggaaaaaccggaggtaaagtggctgatcaatgcggcaggctatggaaagatcggtgatgtgggaacaataaacttaggggatgagatgggcatggtggatttaaactgcagggccctttgtgcggtgacccatatggttcttccctacatgtcgaagaacagcaggatcatacagttttcctcttctgcttcctttttgccccagcctggttttgccatttattcggccacaaaatcctttgtgttaagctacagcagggcactgaatgaagaactgaaaaaaaaggagatctatgtgacggcagtatgcccgggaccagtaaagaccgaatttttcgatattgcagagaccacaggacagatccctctttacaagcggctgatgatggctgatcccaggaaggtagtgcgccttgcattgcgggacagcatgatgggccgtccggtttctgtctatggaaccaccatgaaaaccttccggcttttatgcaaaacagtacctcacactgccattttcagccttatgaaaaggcttatgaagactatgcccggtgaggcgggggcgctgtgacccttggtcattgtgactatcccattgacaaaagcaggcaaaggaagaggaatacgaaagtgaaacgatacaggaagggacagtacggttatcgtaattatcataaaaaggcagaacttggaaagatccttgcaggggcggtcctgatcctggcacagcttttggcccgggggctggttgatggttcatcctggaaaaacatcctgaccatcacggcggttctttccgtgcttccggttgctaatggggcttctcccctattagcagcctggaggtataaaaccctgccggaggagctttatataaaagcttcttcttatgaaggaaaagtcagactgctttatgatctgatcatcacctccagggatgcagtcctgccggtggatgtggccgcggttcatccttccggcgtctatgtttactgtacggccaaaagagtggataaagagaaggcagaatgtttttttaaggatatgtttctcagccatcagctgaagccggaggtaaggctctttttggatgaaaaggcgtttttaaacttcctttccggcttaggaccggaaacagagtataaggatgacggcagcgtggagcgcgcctcctccctgttaaaaagcctgtccatgtaagtgacaggaaagaaataccctttgggattagccctgccaaagttcatggcaataatcacagaaaggacagatcatgcagtctttgatcgtatcacaaaatgaagcagggcagcgtttggataagctgctttccaaatatttgaatcttgcagaaaaaagctttctgtataagatgatgagaaagaaaaatatcaccttaaacggaaaaaagtgtgacggttcggaaaagcttgtacagggagatgaggtcaagctttttctttccgatgaaaccattggaaaattttctcagataaagcttccagaggtaaagaaggtatctttaaacattatatatgaggatgagcacattcttctggtaaacaagccggcaggcatgctctcgcagaaggccagggaatcggatgaatctctggtggaatacatgatcgattatctggtttcaagcggccagttatccacagaacagctaaggagcttccggccttctgtgtgcaaccgtctggaccggaacaccagcggactggtggtgggaggaaagtccttggcgggccttcagctcatgtctgcctcctttaaggaccggagcattcacaagtattatcagtgcgtggtaaagggaaagatttcagaaagacaggtgatcacaggctatctgacaaagtcagaggcttccaatcaggtgacagttcataagcagcaggtaccaggaagtgtccctattgtaacagaatacgaaccggttcaatatcatgaaggatatacgcttttaaggattacgctgatcacaggacgtacccaccagatccgcgcccatttatcttccatcgggcaccccattgcaggagattataagtatggggacagcagggtcaatgaagaagcaaagaggctttaccatatccattcccagcttcttcattcttaccaggtgattttcccggaacttccggagcctctttcctatttatcgggacaaagctttttcgcgcctctgccaaaaaccttttcaaagatatgcaaggattggaggtaagatagaaagatgggaacctggaatacaagaggattaagaggctctgccttagaggatttgatcaaccggagcaatgaaagctaccgggaaaaaggcctggctttgattcagaaaatacccacgcccatcacgcccatttccattgataaggaaagccgccatattacactggcttattttgaccagaagagtacggtggactatattggggccgtccaggggataccgatttgctttgacgcaaaagaatgttcggcgtgcacctttccccttcagaacattcatcctcatcaggtagcctttatggaagaatttgaaagtcagggaggaattgcctttatcattttatcctatacccagaagaatgaaatctattacctgacctttgaccagctgaaacggttctggaaacggatggaggatggaggacgtaaaagctttacctatgaggaagttgataaagcctggagaatccggagctttcgggatattttcgttcattatctggaactgatccagaaagatttggatagaagagattgacaagaaccactttttcccctataattgactacacgttatcgaattatcactttactataagaaagtggtaaaaaatgatgagtcgtgaaaataattttcttcactgcttttttgacggctcactgtggatatgcgaagcagaagacggaggttgttatggcaaataaactgttacatacaccggacggagtccgggatatctatggagtagagtgtacgagaaaggctgccctgcaggagaagatgctgaaggttttccatttgtgcggttatcaggacattgaaactccgacctttgaattttttgatattttcaatgaatcccggggaagtgtcaaggcaaaggagatgtttaagttttttgacagggataaccacactctggtgctgcgcccggatgagacgcctgccatagccagatgtgcggccaagtattttctggacgaggatatgcccatccgtctttgctatattgagaggacttttataaataattccagctatcagggcaggctgaaagaatccagccagactggagtggaatttatcggcgatgattctgcggatgcggatgcagaggttctggccatggtgatcggggctttaaaagcagcaggtctgacggaatttcaggtggaattaggggaagtggatttcttcaaagggctgatagaagaggccggcatggatgaggaaatggaagaagctttaagggagcttattgaaaataagaattatttcggcgtggaagagctggtcatggcacagcccatttccaaggagctaaagcaggtgtttttaaagctcccggagctgttcggctctttagaacagattcaggcggccagggagctgacctccaatccaagggccttaagggccctccggcgtttggaggaggtataccggatccttgaacattatgggctttctgattatatttcctatgatcttgggatgctgagccaataccagtattataccggcattattttcaaggcttacacctatgggaccggggattatgtggtaaatggcggcagatatgataagcttttggagcagtttggaaaggattctcctgctgttggctttggaatctctgtggatgagcttttgctggctctttccaggcagaaaattgagacagaggtttctgtggtaaataccatcatcctttatgaaaaggaagccagggaaaatgccatccgcctttctgatcatttccggagttccggcatggcagttcagcttcagcgaaaggatatatcccgttcccttgaagaatatcaggcctatgcaaggcgcagggaattaaacaatctgctgtatttggaccacagcggtttttctgtaagggtcatgaaccttgttctggaccgtacagatgagataccgctggcggaatatttaaaataatcgggggaacgtatgagatatctgacttttgcccttgcaaaggggcggctggcaaaacagtcacttgaaatgtttgaaaaaatcgggatcacctgtgaagagatgaaggataaggattcccggaagctgatctttaccaatgaggaactgggcgtgcggttcttccttgcaaaggccagcgatgtgcctacctacgtggagtatggggcagccgaccttggagtggtgggtaaagacaccattctggaggaaggaagaaagctatatgaggtcatggatctggggataggaaattgcaccatgtgcgtttgcggcccccagtcggcggtcgagcttttaaagcatcatgaaaggatccgcgtggccaccaaatatccggccattgccaaggactatttttacaacaaaaaacaccagacggttgagatcataaagcttaacggttccattgagctggcgcccattgtagggctttctgaggtcattgtggacattgtggaaacgggaaccaccctgaaagaaaacgggcttacggtattggaggaaattaccccttatctgcccgcatggtggtgaaccaggtaagtatgaaacgggagaacgaaaggatcacaaagctgatccatgatttacgtatcctgctgcaggaggagaaccgatgagaattgtaaaactggacgaagcttccaaacaaaatattcttgctgatctgttaaaaagagatcccaataattatgaaacttacgcggatacggttcaggaaatcgtggaatctgtaaagcgggatggagacagggcggtatttgcctatacaaagaaatttgataaagcggagatcaatggggaaaaccttaaggtgactgaaaaggaaattgaggaggccatgaaggaagtggatccaaagctcatggagatccttcagaagtccatgaaaaacatccgacggtttcacgaaaagcagagacagtacagctggtttgacagtaagcctgacggcaccatcctgggccagaagatcacgcctttagaaagcgtaggcgtttatgttccgggggaaaggcggcatacccgtcgtcggtccttatgaacatcattccggcagaggtggccggagtgaaccgcattgccatggtaacccctccgggaaaggatgggaaggtcaatccggtcactttaacggcagcccatctggcgggtgttaccgaggtctataaggtgggaggagcccaggcggtggctgcccttgcctttggaacagaatccatcccaaaggtcaacaaaatcgtagggcctggaaatatttttgtggctctggcaaaaaaggcggtttacggccatgtgagcattgacagcattgccgggccaagcgagatcctggtgcttgcagatgaaagcgccaatccccgttttgtggcggcggatctattgtcccaggcagagcatgatgaactggcatccgccatattagttacaaccagcatggaactggctgaacgagtgtcagaagaagtggaacagtttaccagagaactgtcacggacagagatcattgagaaatccctggaaaattatggctatattctggtggcggacaccatgaaagaagctgttgcagcagtcaatgagatcgctcctgagcatttggagatcatcaccaggaatccttttgaggacatgaccaggatccagaatgcaggcgccatatttatcggagaatacagctcagagcctttgggagattattttgcaggaccaaatcacgtgcttccgaccaatggaacggctaaatttttctcagccttaagcacagatgatttcataaagaaatccagcatcatttactactcaaaggaagccctggaagcgatccatgaggatattgaagcctttgctgaagcagagcatctgaccgcccatgccaattctataaaagtgcggttctttccacgatagcgatgagcagtgcggaataggacgtgataagattttcgttgtgcttgcacataagaaaatcttatcatggcctattccatagggcgaatgcccgtgagctcgtaaaacctgcggttttacgagctccactgcggacttatttacttatttagcactgcggacttatttacttatccaacaataaagcaatgaaagaaggataaaaaatggaacgaattgcagatatttcccgggtaacccatgagacagatatccagttaaagcttgacttagacggcaccggaaaggctgaaatccacactgggatcggttttttcgaccacatgttaaacagctttgcacgccacggtctttttgacctgaacttatcagtaaagggagatcttgaagtggacacccaccacaccattgaagacacgggcattgtccttggaactgccatcaaacaggctcttggaaataaagcctctattaagcgctacggcagcatgatccttcccatggatgagaccctgatcctctgcgccgttgatttatcaggcaggccatatctgagctatgatgttttgctcactgcggaacgggtgggggattttgagacagaaatggtgaaggaatttttctatgccgtttcctatgcctcagaaatgaacctgcatatcagaaaactggcaggagagaacaatcatcatatcatcgaagggactttcaaagcctttgcaaaggccttagatgaggcgacctcacctgaccagaggatcacaggggtgctgtccacaaagggaacattataaaggagaatcatatatgcagctttatccagcaattgacttaaaaaacgggcagtgcgtccgtttgaaacagggagaatttaaggagatcaccgtttattctgacaaaccggaggaggtagctgccctctggcagtctcagggtgccacatttcttcatctggtggatttagacggagctttggcaggccgctcagtgaatgatgaggtgatcaaaaaaatagtggatacagtatccatacccattgaaataggcggcggcattcgaagcgaagaggccattgaatccatgctctccctgggagtggcaagggtaatcattggaacaaaggcagcagagaatccggaatttatccgggatatggtgaaaaggttcggccaggaacggatcgtggcaggggttgacgccaaggacggaatggtggctgtggaaggctgggaaaagatcagcggaatttccgcatcagagctttgcagccggatgaaagagtacggagtccgccatgtggtgtatacggacatatccagggatgggatgctgaccggtcccaatgtggaatatacgaaaaaattgacagaagaaacaggaatggacatcattgcctccgggggaatgtcttccatggaggatttaaggcagctttaccaggcgggtgttcatggcgcaattatcgggaaggcgctgtatgaaaagcggatcgatttaaaagaagctattgaagcctttgaaaaacagggccgtcagggaggatatgatgatggagtataaaaagctgattgcgggttttggaatccgggaaggaaaggccgtcaggcttgaagacggtcagatgtgctatggggaagatcttttgtcccttgcctgtttttatggggacagcggagccgatgagcttttcctccacgatttgtcggaatcggaggaggatcatgagcggaccatcggcctgatgaaggaaattgccagactgtctgatattcctgtgattttagggggaagagtaaaacggctggaggatgtgaagaaatatctttacgcaggagcaaaggcagcgtttctcgacgtaagcctggatgaaaatgtggatatgatgaaagaggcggctgaccggttcggagacgataagatttatgcttatcttccggactgttcgtatttggagcggaccaaagaatatgcccagctgggagcctctgtcatgattctgggagatccggaaatcacggaggaaaagcttcaggccgtttcagattgtgaggaggcctttctggtcaccggctgcggggaagatgcggccctctttgcctttgcccttgtgatagaaaacgtggagggcctggtgggaagctttgacggagaggtgaactgcatggatctaaagcaggaactgaaatccctggggatcggggtggatacctttgaaagtccggtaagtttccggcagtttaagctgaatgaggatggtctgatcccggtgatcacccaggattacaggacaggggaagtgcttatgctggcctatatgaacgaagaggcgttttatgaaactttaaaaaccggctgcatgacctattacagcagaagccgccgcagcctttggcgaaaaggggagacctccggccattaccagtatgtaaagtccctgtccttagattgcgacaatgatacacttcttgccaaggtgaaccagatcggggccgcctgccatacaggggcgagaagctgcttttatcagaatctggtgaaaaaggaatatcaggagagcaatcccttaaaggtgtttgaagaggtatttaaagtaattcttgacagaaagaccaatccaaaggaaggctcctatacaaattacctgtttgacaaaggccttgacaagatattgaaaaagctgggagaagagtccacggaaattgtaatagcagccaagaatccaaatccagaggaagtgaaatacgagatttcagatttcctatatcatatgatggtgctgatggcttacaaaggcctgtcctgggaagatattaccagggaattatctaaccgttgatccttataaaacgctgggaagctgatgtctttccagcgtcttttggtacctgcagcaatggacagcctgaccgccctatggtataattaggaaattgagacaaaaggaggccatgagtatgaaaacacagatgtcccggaggatgaaacgaatgacacagctttaccgctgggtgataccggtggttctcctgtatatcattgctctttccttttttctggctggaatgggaatgaagcttttgggaaacacggaacttaaggaagaaccggcggagtttcatgtgtatgacggggcggatatttacagcagcttaaaggctcagatgatgactctggagtttgcgtcggattttaaggagacgaatcattattactttgcttatgacgaagagcttttgccctttattgtacaggttcatggtgatctgtctgaagagtatttaaggatccagtcctatttgtatgatgagtccgaggtagcgccggagccggctgcattttatggcatgtctgcgcccattgaggaagatatccggaagtatgccatagaaagctacaatgatatgtggggccaggaacttgtgacagaggctaatttttcggactatttcggagaatactatctggataccacaagaaaaccggtatccaatgcctggaaaacaatttctgtcatttttctgtatgcatttacggctgcgctggccggaaccctgattctggtatggaaccttaacagccggagattaaagaggagccgcaccacattaaaagcttggccggaagaaaggctgcttcagctggacgaacagctggctggagctctttcccttgtttatggaaaaaagctgctttatctgacagaggattatatggttactgacggggaagggtttgatatcatcccgtacaaggccgttgacaggatttacgatacctccaccgtaacagaaaaaaggctttcggctgaaacaaaggatggggaacaccatacccttgcctttataaaaagaggagggcacataaaggaagcagcgttccaggagctgatcaaccaggtgaaaaagaaaatagcggataaaaaagaggaatttccggaagatctcctgccagatagatatccccttggcccggaacatggggagccggaagcagcccttcaaatatctgcctctcttgaactgaatccgtctaatcccttccttggagtgatcggcgcactgtttgcctcgcttttgggagttgggttgtgggtgctcatcggacaggtggggtttgtcgccgggatagcaggatttgtaatgctgaagctggctttaagcggttatgagaagcttggaggttcactggacaaaaagggagccgtcatttgtcttgtaataacagcgggaatgatagcaggggccaatcttctggattatgcagtatccatggtaagggcatattttcaatatgaagccagttttgaaaccctggtctatattttcacaaactttggaagcctgatgtctgatatggacatgtggaacggatttttccttgatctggccatcggttacggcttgtccatatggtccgcagcaggtgccatcaaagccattattaatatggaaaaataaaattttagaaaaagaggcgattgaatcatgtcagcagtattgaacaattttttaaagtatatatcctttgacacccagtccaaagaggatatggaggcagttcccagtacagaaaagcagagagtattagcaagagaactggcagcccagcttcactccatgaaggcggaaaacgtgatggtggatgaccacagctacgtttatgctaccataccagctaccacagaaaaggctgtacctgttcttgggtttatcgcccatatggatacatctccggcctattcaggggaaggagtgaagccgcagatcgtgaaaaattatgacggcggtgatattctgatgaataaggaaaccggcctggttatgaaaccctgcgatttcccggaccttttaaattacaaggggcaggatattattacaaccgacggaactactctgcttggtgcagatgacaaagcaggagttgccgagatcatggctatggcggaatatctcctgtcccaccggtcgatcccccacggaaccatccgcattggctttacaccggatgaagaagttggaagaggggctgatttctttgatgtaaagggttttggtgctgatgtggcttataccgtagacggcggcggattgggagagctggaatatgagaatttcaacgcagcttctgcaagagtcattgtgcacggctccagcatccatccagggtcttccaaaggaaggatgagaaatgccctgctcatggccatggagttccacaatatgcttccagctgcggaaaatcctatgtttacagaaggatatgagggattttatcatctggatcacatgaacggaaccgtggaggaagcccgtatggattacattatacgggatcacaacaaagataaatttgaagcaaaaaaggcatttatggaaagggtggcggaatatctcaatagccgctattgtccaggaaccgtggagcttaccttaaaagacagctactataacatgaaggaaaagatacagcctcacatgtacttaatcgacattgcaaaagcctccatggaagaaatcggaatagagccaaaagtgacccctatccggggaggcacagatggagcccgtttgtcttatgaaggtcttccctgtccgaacctgtgtacaggaggttataattttcatggaaaatatgagttcatccctgttcagtccatggaaaaggtggtggaactcctccttaagatcgtagagaaatttacggaaagagaataacagagatcaatggtaccctgcaggtaagacacataaagatgtgtcttacctgcagggtatttttatgtgctttcgcctgttttgcatggttgggtttctctttagaaaagtaactcccacgttgcaggtactttgctttcatgagtccaattttgcgcaatggtaaaattgataattgtacacaatggttgtggatatgggaatagcccaatggtataatttgcacataacaaattgctttgacaattaccggtaaaagataagcatagaaggaggttacatttgaaaaaggatatgttatttcgggaactggttcagctggactgggaagcggcggatcagaccgaagtctttgaacggatggcagacattctgtttaaaaacgggtttgtaaaagacacttatctggagtcactaatggcaagggaggaaagttatcccacagcacttcccattaagccttacccggtcgctatccctcatacggataccagccatatcctacggccgtttatcgctcctatccggctgaagaaggctgttgagtggagggaaatggccaataatgatgaaatccatcaggtccggttcatttttatgctgggatttttaaaatcagaggagcacattgatttacttcagatattggtggagaactttcaggacgaggaattgatggagcgtttgaatcatgccgggacagcggatgaatattttgaagcggtcagcggcatcaagggtatggaatcataaacagccgtaagaaaatcggaggaggttttgactatgggaatcagagttattgtggcctgcggaagcggtgtggctacctcacagacagtggcaagcaaggtaaacagaatgttaaaggaaaagaaggtggatgctttggtggaggcggtagatttaaagtccgttgaccgctatatggacggcagcgcggcctatatcaccattgtaaagaatgccaaggaatatcccattccagtgatcaatgggatcgcatttctgacaggtattgggaaagaccaggaatttgataaactgctgaaggcaatcgaaaactacaaaaagaaaagtctataaaaataaggaggtaaatgagaatgcagatgttagcgaatacggttaatttctttctggggcttggggcggctgtgtttgtgccggttatcattattatcgccggtttgattgttaagatgaaagtaaaagacgctgtttcatcaggcattacccttggtgtggctttctccggaatgagcatgctgatcaactatatgaccggagtgatcacaccggcggcaaccgccatgttaaagttttccggcattgatcttcccattaccgatgggggctggaccaccatgtcaaccatatcctggtcctggccttatgcttttttaatgtttcccctggtgattgtgatcaatattatcatgctggcaatgaaaaagacggatacctttaatgcggatttatggaatgtatgggggaaaatttttacggcagttgcagtatattacataacccgcaatgtcatggcagcatttgcggttgcggcggttcaggtggtgtttgaattgaaatccgctgatttccatcagcaccgcattgaaaagctttccggcattccgggagttacatgtacccataagatggtttttcttgcggctcctatgtatattgtggactgtatactgcgaaagatcccaggcttgaataaatcctttaatgcagaggacttaaaggagaagctgggtatttttgcggaaaatcacattttaggctttcttttgggaatcattttcggatttttggcaagatatgacctggcaggaatactgacccttggaatacaatgtgccaccgctttgaccctgttcccagtaatttccaaatatttcatgcaggccctggagcctatttccaatgctgtttcagaattcatgcagggtaaatttgcggacagagaaatgtatgtcggactggactggccgttccttggaggtgcaaatgaaatatggctggccgttatctggacagtgcctgtgacgctgattatgtcctttatccttcccggaaataagatcctgccctttgccggcattattaatattgcaattgcagtgcccgcgtaccttgtatgcaggggaaacatcctaaggatgcttatccaatgtaccatttttacgcctgtattcttgtgggtcggaactgcatttgctccctttatgacagaactggccaacaccacaaaggctgtggagcttgcttccggacagatgatttccaactcaagcattgacggccctatatttacttatgcattttcacacgcagtaaaggcgctgcagggagagtttcttcctctgatcattctggttctgtggatcgtatgctttgttctttattcaaaaagcctgattcaggaaaaaaaggaagatatatccgcctgattccttaggaggcaaatcatgaaaatcggccaacgaaattgcttgattttgaaagaaattgttaatcatagtgcgtctgtcaccggaaaggatctggaggcaaagctgcatctttccagaaaacaactggagtatggaattactagaattaatgaatatctggaggaacagcagctgccgattctggaacgggtaaacaatgggaggatcctcatcccaaatgaagtgattgagcagctggatttcaaccggctggaacaggaaaatcaggatgtctggctgtccaaggaagagcgggaggatattattcagctgatgctgctgacaaagcagcaggaactgtcgctgcagcattttattgccgaattaaaggccagtaaaaatacggtgctggcagatttaaagcgattaaaagatgaaatgcctggttccagcctccagcttacctacagcagggaaaaggggtataggctggaaggcagggaatatgacctaaggcagcggctgttccttatactgcgaaatattttgtccggaagagggcggcaggccatggttttccggatgggaaaaatcaccgcaaagcaggtagagcaaatgaggaatatgacggaaaccatcgaaggggaattaaaaacccgctttaccgatgaaatgttcgaggtgaaccggtgcttttttatcctggttctcaggcggatccgggacggcctggttttagacacggttccggaaaccttccgtcatatggcaggaacaaaggaatatatggtgatcaaatcctgcctgtctgccgagggtgtgaacagtatttatgagaccatgtattttaccgcccatatccagagcatgagaattaactcccatttagaggctgttgcagggcaggaagaggtttaccatgctgtggaggagacgatcagcaattttgagcggatcgcctgtatttgctttgaaaataaagatgataccttccatctgctgatgaaccacagccttcctgccctgtaccgtatcagatataattttcacataggtccagatatttcagaatatgtacttcctgcctaccaggaagtacatgacatggtgaaaaagtctgtggcaccactggagaaactgatcggaatgtcttttccggaaagcgagctggtttatatcaccctgatttttattgcccagaccagcagagaggatgaggaagagaaaactgacagacgcccccgtgcggtggtggtgtgccagaacggtgttaccgtatcccattttctcctgacctccttaaaacggacctttccggaaatcgactttttaaactatatgtcggcgcgtcaatttgatcactatggggaagaatttgacctggtgtttacaacggcacccttaaaaacgtcaaagaagcaatttgtgatcgaaccgctgatggacaaagaaagaagaaaaaaacttcgtaaaaatgtgtttgagagtctgaaaaattcaggagaaatctttccccaggtagaaaccatacttcaaattatcaagaaacacacaaatgaaagcgtatttcagaagctccggatggaaattgactcgtatatggtacagtccgatcagggagcaggaggaaagatagaaaaacggaaaccggaactaaaggaactgctgacaatctccaatatccggatcattaaggaaagcatgggctggaaagaagccatagaatttgcagcagtgcccctgctgtacaaaaatatcatcaaataccagtacgttgaaacgatcatttccaatatcatcaaataccggcagattatgctgattgcagagcatgttatgatcgcccacgcggggatcgatgcaggggtatatgatgtgggcttctccatgcttctcctgcctcagaccattatggtaaatgattatatggaggtaaaggtgatttttgtgttggcaactccggattatgagagccatttggcagcgttaaaccaactgatcaatattttagaggatgaaaagaagctggcagcgatgaaagaagctaaaacagcagatgagattctggaattgctgtagcaggccattataaagccatttcattaaatcggcaaaaacgaagcagaaaagaggaaaaagaatgcttgaaacattaaaaaaggatgtgtgtgaaatagcaaaacgtgcgcagagagatggattatgcaagcataaatccggaaacttcagcgcacgggatctggagaccggttatgtggtaatcaccccaccagtgtggacagggaattactgactcccagggatatggttgtcatggacttagatgccaatgtcattgaaaatctgtccggcttaagacccaccagcgagaccctgatgcatctgatgatctaccgccagaggccgaaagcagcggcagtcgcccatacacactctgcctatgccactgcatttgccttgttaaataagcctcttccggcggttgtatatgaagtggctaatttagggctgacaaaggctcgtgtccctgtggccccttatggacggcccggaaccacaggactggcggagagcgtcattgaaagctgtttagaagcggactgctttttgctggaaaagcatggtgctgttgcagtggatgaacgtgatatttacgaagcatttttaaaggcagcttatatagaagagctggcagaattatattatcttgcattgacggcaggcggtggaaaagagccggagggctttatgccggaggagctgcaaagatgggaatatcccaaagagatttcatttcccaatgcaaaataaggagggctcatctttgaaactatatctgatccggcatgggcggcaatgcgacaaacggtgtaatgtggatgtttccctttcggaagaagggattcgtcaggccaggcttaccggaaaacgaatgaaggactggggatcgaaatggtctattccagtgacatgcttcgggcaaaggaaaccgcataccatgcaaatcaatactggaatgttccccatgaaattataccggaattccgggagctgtgctttggtcaaatggaaggcctgtccgacgaagagatccaggaaacgtttaaggattttaaggcaaggcaggatgagatgaaggtggatatcccctatccgggtggtgaatcagcaacagagctggttcatcgggcaatgccccggcttatggaggtagcagaacatcataaggggagtgttgccattgcaacccatggagtatggatccgcgcagttctatgccatgttctcggcatagatatggcaagatggaggaccattggagtcacctttgagaatggaagcattacggaacttcattaccaaaagagtaaaaataagtttaccttggaacggtttaatgattatgcgcacctggatccatatcctgagctgcttcgcggtgcatggggagtagaggaaaattagctggatttctgtctcaacaatagaaggagctggattgtatgaaaaagatgattaacagcgcggatacatttgtccaggataccatggaaggtattatctgcgcatacggtgataagttaaagctgttacataatgattttcaggtgctggtatccaattatcccgccagcaaaggaaaggtgggagtggtaacggccggaggaagcggccatcttccggtatttttaggatatgtgggaaagggattgctggacggctgtgcggtaggggaagtattcgcctccccggcggcggctaaaatggccgatatgatccgcgcctgtgacaggggcagcggagtgctgtgcttatatggaaattataacggcgaccgttttaatttcaccatggcctgtgaggaagtggagtttgatgacattcagacaaaagcggtgcttgtaaaggatgatgttgccagctctccagcagaaaatgcggagaaacgcagggggttgcaggcatggtatatgcctttaaaattgcgggagccgccgcggataaaatgatgaaccttgaggaagtggcagctgtaactgccaaagccctggacaacatccgttccatgggcgttgccttatctccctgcatcgttccaaaggcaggaaagcccacctttaccattgcagaggatgagatcgagatcggaatgggaatccatggagaagcaggcattgaggtaagaaaaatgatgactgctgacgagattgcagaaaccctggtaaatgtgatcataaaggatatgcctttagaagacggggaagaagtttctgttttgatcaacggacttggggggacacctttagaggagcagttcattgtttataaaaaagtatatcagatgcttaacgctttaggagtcaggataataatgccccacattggagaatatgccacctctatggaaatggccggcctttctataacgattttcaagctggatcaggaattaaaggaattgctgctggctccggcagaatctccattctataccaattcaaataaataggggaccattgtatggatcaaagatcaataaagggaatcattgaggcgatcagcggggaaatgcttgcaaaccgggattatttggtggaactggaccaggtaaacggagacggggatttagggatttccatggatgacggctaccgggcagtggcagagtatttaaaaactgctgaggaaaaggatcttggaaggctgatgatggcatgcggcaaggtattcaatgcctccgccccgtcttctctgggaacgatcacttcctttggctttatgggaatggctaaggcgctgaggggaaaagaagtggtgagctttgaagaagcagcaggagcaatgcttattggagtggaaaacatcatgaaaaaggcggaatcaaaagtgggagaaaagaccattctggattctctgtatccgggagtccttgccctggtaaagtatgcttctgatccgaagacagcagtaatggaggcagtaaaagcagcagcagaaggctcagaagcaacaaagcagatgagggcagttcatggacgtgccgcatattcggcagagcggagcatcggcatattagacggtggctctgtggtggggaagttgatttttaaggggattgctgattattatgaggcaaagtagtaaaaatttatcttgtaaaaaacttagggataattttaagccaaaaaagaaccggattctttgactaatgatccggttcataaggcagcagatagttttgtaagcaagagcagataccttataaggaagtatctgttcttgctttatttatggcagcttcaggctgacataatgacattaaagtgcagtcccctttttcggtacaaacaggagagaggtatccacaccctccaattcgagtaattttgtttttactccgatgcccccggcgtatccggtcaagctgccgtttgaccccacgacccggtggcaggggattattatagaaataggattatgcccgacagcaccgcctaccgcttgactggacatactcatcctgttcatctttacagccattttctttgctatgtctccataagtaataactttaccatatgggatttcacataatatattccacacgccctggcggaattccccgccaatgggacctagcggcaattcggaaatctctggcttttctccggaaaagtacctgtccagccatttctttgcagtatcaaacaccggcatgtcatttcttttcgtcatttctccgggtatcgtattgccatgatatttttgcccttcaatccataggccaagaaggttgtctctgtcgcacgccagagtcatcagccctacaggcgattggtaaaatgtagaataatacatagttatctctcctaatatgtgtgagttcaattgtgagcaccaaaggatgatagtagcgtagccgctctatttcctctatttcaatcaattttttgctatgtgagatataagctccttttcatatcaatgtcagtacaggaaaagtttgtaatattccgctattattgtttgtcaccatatattcatattcttatttgaacttgtccaaattataccacggttttttaaaaaatgctattttttagtatagccagggaattaaattttctcctatttatctacttttcagatactttgaaaaaacgagacatgcagcagtaggctttactcctcgtatcaaagtgcttatatatctattttggcccaaaacaatgtgtctgttaaaatactacaaaaaacgtgttttataattcggtaaaatggtatttaaaaagatatagttgtctattttgtataaaaacacaatatttatatggggaatattgacattttgtaaggtttagtgtatattgataccatagttaagcacattaactatttaagtggtttacaatgcacacaaaaaaaggagaggaggtatttatgaatatcaaaaaattatttgatgctcatgaaaatgaaatcattgaaaaccgtcgttggtttcacaaacacccggaggtatcattcgaagaaaaagagacctctgaaagaatttgtaagaagttagaagcgatggggattccttacgagaaattgctgcccaattacgggattgtggcaacaatcgaggggcaaagaaaaggaaaaacacttgtgcttcgtgcggacattgatgcgttgcctgtcaccgaagaaacaggactttcttttgcatctgaacattctggcaggatgcatgcttgcgggcatgatactcatgcagctatgctgcttggtgccgcttatgtactcaatgaggtgaaggaagaactttgcggaacagttaaatgtgtttttcaggttgcggaagaaattgggggcggttaccaggaagtattagattatttagaaaaaattggcggtgtggatggcattattggtctgcacatctggagtgcgataccggaagggcaaattttgctctatcctggtgctgtgtttgctggtgctttgggttacacagcaaatattaccggaaaaggagggcatggtgcccggccggatttaacctgtgatcctattaaagcggcctgtgaactggctcttcagtttgcatcgataccttccaatttctatgatgttctggatcactctgtagtaaatgttggtattattcaggcgggaacacttggcaacatcattccttctgaagcgatgctaagaggagggcttcgctggtataaagatgggggaggagagaagattctgaagctcatgaaacgtatggcagaagggatcggcattgcgcataatgtaatatgcgaactctctgttgatggcggtgttccgccggtaatgaataatataccaatgcttgaacgggcgaaaacacttttaaaagatatggaaggtttacgtatttcagatcaagcggatcctatttgtgcgggcgacaattatggttacttggtacaggcttatcctgggttttacggtatcttaggcggcggtaagagtgatgaggaagtttatcctcagcatcatcccaggtttgatgtggatgaaaaagcctttcgaaaaggagccgaatttatgaccagatatgcaattgatttcttaagataagggagaacgtatatgagtataaatcctggtaaagaaaagaaggcatttcggatgccacacctgttttggattatgatggctcttcttctgtttgcttgcttattgacttatattgtgccggcaggcgagtttgctgtggatggcaatggaaagattatgggagagcaatttatttacaagggcagccaaagcccggtttcaccttggcgtatgctgcagttggttctaaatggattgaatgaatctggtttggttatctggacagtattgatatccggtgcaatgacagcagttgttatgacaacaggtgccattgatgagctcctcaattgggctatttataagctcaaagattccaatgaaaacatcctcatttccattttgtttatcctgatggtttatctgggtgcatttggagggaccgatgcattgattgcagtagtacctattggtgttattttctgtaaaaagctgaaacttgattcgatctgtgctattggtgttaccagttatgcaaccttgttaggttttggtactggtcctacaaagcagtttgtaacgcaaatgatgatggatgtacctgtttacggagcctttttcacaatgtttatcagtatgaatatttttctggcattggggctattttttctgcttcgttatataagacgtattcgtaaggatccgaaaaaatctttgatgtggagtgaaggctggaatcctgacagtgtagtggttactgaagaagatgagcagaagctggtggctggaacaagtctatccatacgctcaattctaattatgtttatattcctggctcaatacggtgttatcgtagcatatccccttatgggtggaaatactgcatatctgatgcacctgatgacagcattagctttattggttgctataatctgtggttttataggcagattctcttttgataaaattggtgatgagattgtgaaaggactgcaaggtctggtatttgttggttttgtcattggtctggctcgcgtcatgtcactggtattaaccgaagggtacgtaatacatacactcgtttatgggctcacgcgcccgctgatgggtttaaaccgctccgtatcttccattgcaatgaccgcaattatctctgttatcaatttgttaattccgtctgcaacatcgaaggcagcgatattggttcctattttgaaaccaattgctgagactttgcgtatggatcccaatctggcggtgcaggcattccagtacggagacggctttacgaatatgatttcacctttcctgggatggacggttggttcttgtgttatggcaggtgttccattccctaaatggtttaagtgggtaataccaaaagttattgcttttatgcttctttcttttgtaatgatgtttattctgaccgaatctggttgggttgcgttttgattattatgatataaagcagaattaatgcagataaatgacttaataaatatagtaaggaagagtaaatttatgaaatataattttgatgaaatgattgatcgcagcggcactttcgcagcgaaactagatgcgatgccagaaggggctgtggagggttctctttcagtatgggtagccgatatggactttgcctgtgctcaacctattttagatgcactgcatgcccgtattgataaaaagatatttggttataccatgtacagcaatgatgagttatctaatgcagttaccggttggtttcgccgcaattatgattgggagataccgaaagaagatattttcttcagccccggtgtggtgccaacacttgcttttctattaaatatattgacagaagagggagacggagtgattattcagcgcccggtttactacccgtttacgaataagatcacaagcaacgggcgccgggtttgcaacagctcacttttgtacgaggctgacggctacaaaatggattttgccgatcttgaagagaaattttctgatcctgaaataaagggcatgattttatgcagtccacacaatccggttggacgtgtctggtctaataccgaattgcgtcagctagtagatattgcaaaaaaatataataagtggattatttcggatgaaatccatatggatctgacacggaaaggagtcactcatacgcctcttttaaaagtggctcccgattatgcggatcagattgtggtttgtacggcaccttccaaaacctttaacatggcagggatgcaaatatccaatatcattatttctaataaagactggcagcagaaatggacggatctggttgagggaaaatactcagtaaatatggcgaatccctttggaatagtggcaaccattgcggcttataacgaaggacaggaatggctggatcagcttcgggactatctggacaataatattgaactgatagaggactatttgaaaaagtatttaccgaaggccaaaatgtttgtgccggaagcaacctatctggtttggattgacctgaatgcttatgaaagcgatccccaaaaacttgagtataatatgcaaaagaaagccaaaattgcatttgatgaaggttatatttttggtgaagaggggaatggttttgagcgtatcaatattgctatgccaagcagtagggtgttggaatgtcttgacagaatgacggcagttttaaatacaattgattagatagccagatgtagtttacaaaaatagccggaaaggttttcaaaccattccggttgttttgtttgtatcacagtaagaaaatcccctgccctgaaaccacaaagaaatgatgaaataaaagaataatttaatagaatctgtattcaccaatcccattggagacaatcgcccttgtgcttgttgttggattatattataatgataaaagtcatggcctgaaacagtaaggagatattgctatatggaaaacagatcgaaaacaaaattaactgaccacattggatttcacatgcttttggcggcaacaggcggatttatggatgcttattcatacgttgaaagaggcaatgtatttgccacaggacagaccgggaattttgtcctggctgcgatccgttttttctcaaaggattacaaaggcatgggccaggcctttgtacccatcgcagcattctttgccggagttttccttgcaagacatttttattatgaaatttataaagaggagcataccaattggatatccggtattttatttctggaaattgcggtattgtttttggtcggctttatccctaatacggtacctcatctgtttgccaatacagcggtatcatttgctgctgcagtacaattttgtacctttcgcaatttcggaggaaactccgcctatgcgccggtcttttgtactggaaatatgcgttcctgtgcggaaatgtattatgaaggctttgtgagaaaggacaaggtgtgcaggaaaagggcataccactacaccgggatcctgaccgctttcttcgccggagcccttacaggaggcggactgtccgtctggattggggaaaaggcgatctggatggtatgtgcgctgctgctggtatcatggaaaaccgttgacatggaaaagaaaggccaaaaagcagagcagcttctgccgtcataaacaacggatccggaggtcctctgactaatggcactttcttttacataaaaacattatagcgtacatgaagatcatgaattctttttaatatatatctttaacgctttgatgatcagatacaaaacgtatacgccaactcctatggctaacacataaagaagtaaaagaataagattaataatactaaaaacagccatttcaacacacctccttacataatggttacaaatcagcctacaaatattatcataccataagaaaattgtttttaccacaaaatgacccatggatcatagatttttcgtgttgattaatcgttggaggtattctgtctttttgcatggtttcattagatgacggctagagaaataaacaggcgtctcttgacatacctagagtttctatgtataatatacctagaaactctaggtgttatttattattgataagaggtgaaacaatggataagaaaatgatggcatttggaacatcgctgctgattctaaagcttttggaaacaaaagagatgtatggttaccagataatcaaagaattggaaagacagagccaggatctgtttgtgctgaaggaaggaaccctgtatcccatactgcatagtctggaacagcagggcgcaattataagcactgaaaaagaaggtcccaatggcaggctgagaaagtactatattttaacagatgaggggcatcggctgctaaagaaaaaggaacttgaatggaagcaatatagcagtgtggtaagtcagatacttggaggtgagattatttatgcgggattataagaataacgatgatgtcaggcagttcatgcaggatgtacaagaccagattcagtataagccaatcgtaccagaactctgtagtgaattgtatcaacacatggaggagcggcaggaagagtatatggatcagggaatggatcaggagaaagcagccagagcagccttacaggatttgggtgatccatctgaaataggtgtccgactaaatcagattcaccgggtggagaatcccgggtttttactttggggtattctggcactggtggtgatgggcggcatttaccaaattacttatcatatccaatcttattggtatgcgaaaggctctgcagccgtccaattgatatatctgattaaagaaaatatacatattatgatgggtattccactgttgtttgctgtcatttatctgggatacccatggctgattaagcactgcctcagactcctgaaaggttttctggtttacagcatcattgtatttttgttaaacttgttaaatatggctggttttacacaagacaatttacggccgtttttgtggaatatatatatgctggagctgcccatattaatgctttcggtgcctatgctgatgatattttcatataagataagaaataagtggcgttatgcttttctgatttcaattgccgtatacgctgttatagctttctttggtgctcaccgttccggcgggtttgtaggtttcacttatcaagtgatatttttaattgcttcctttttcatgttcctgtttatggcatataaacgatttttttcagaaaacaggaaaaagagcatgattgcagccaccttgctttgcgtaacagttttgtcagtctggggggcttataaatgggagtcactggagtactattttaaacagtgtttttatcctgatactgtagcgaatgatcatctttctgatgcatataacagtcttttaataaaggatttactgagcagagctgatctgattggtgaagtagagttatcggagcaagaaatgctgtcttactttgactatagctggtattatgatgggatcataagggttgataatcgtgaatggagaagagagccggcagagcttcccgtattggaagatattctgccgcagcattaccacaataactatatgattgcatattttattttatcctatggctggctccctggaatatttttgtttttacttctgtctggaatttgttattggcttttttctattgcattgcaaattcgtaatccgatcgggcagctgactgctttgcccgcagcattatgtattacactgcagacagctttatatataatgggcaatttaggataccaatttggctatttttgcgttttgccttatttatcagaaggtaaagtaaatcatattaccaacatattgttaacaggtatacttctctctgcattccgctatgataaagtgataaaagaacctggagaaaatgatgctgttttctggagaacagaaagcacctgatatccatataacatgaaacggacaatggagcatgagcgttcaatcatgctcttttgttttgtaaatagtgcaaggcccgatttcatgccaatccacacagctcatcagcacatggctgatgatgtgctcatgagggatgaatatattgtccggcagtcaaaaccatgtgaacggtaccgggtccctgtttgatgaattgattaagtaaccattgattgcaaattagatatggagtatccacaagaagtatgctatactaactttgtttatgtttcggttactccttcatagggaagaattctaatgaataatacaagtattttttatgagaatgaaacttggcatcataatatcaaggctattcataacagaacaatccagtatggaagtaaatgttttgtatcaggagacgaagcttaaataatttctgaaaaacaacttctttatttataccaggtgattacaaaacttaagaagtttttgatgaagaagaataaatgtattttatgtatcggccaaactaataaaaaggaattaagtatgagaaaattagcattaagtgatgaaatattattaagggttgaaaaacctgccaggtatatcggcaatgaagtaaacgcagtggtaaaagatcttcaaaaggtggacatccgttttgccatgtgtttccccgatgtctatgaaatcggaatgtcccacttagggatgcagattttatatgatatgtttaaccgcagggaggatatttactgtgaacgtattttttctccctggacagacttggatcagattatgagggagcagaagatccctctttttgccctggaatcccaggatcccattaaggtgtttgattttatcggaatcactcttcaatatgaaatgtgctatacaaatatcctgcaggtccttgatttgggacagatccccttcactgggcagaccgtacggaggaagatcctatcatcataggcgggggaccgtgtgcttacaatcctgaaccattggcagaattctttgatatgttttacatcggtgaaggggaaaccgtttattttgaactcatggaccgttacaaggaaaataagaagaaaggtggaagccgccgggaatttttagagatggcggcggagatcgacggtatctatataccggctttttatgatgtatcctacaaggaagacggcaccatagaaagcatgaagccaaacaattcccatgcaaaggaaaaggtgacaaagcagctggtcgtcactatggacgaggcatactacattgaaaatccggtggttccttttatcaaagtgactcaggaccgggtggttctggaagtcatgagaggctgcatcaggggctgccgtttctgccaggcaggaaatgtataccggcctttaagggaacacagcctggaatatttacaggaatacgcctgcaagctgttaaagagcaccggccatgaggaaatttcccttagctccttaagttccagcgactacactcatttagaggggctggtgaatttcctcattgaagaatttaaggacaaaggggtcaatatttccctgccctctcttcgtattgatgccttttcccttgatgtcatgagcaaggtccaggatatcagaaaaagcagcctgacctttgctccggaagccggctctcagagacttcgtgatgtaattaacaaagggctgacagaagagatcatcttaaaaggagcaggcgaagccttccgcggcggctggaacagggtaaagctttattttatgctgggactgcctacggaaaccgtagaggacatggaggggatcgcagagctttcggaaaaagtggcggagatctactatgaaataccaaaggaccagagaaacggaaaggtccaggtagtggcaagctcctctttctttgttccaaaaccctttactccgttccagtgggcaagaatgtgcacaaaagaggaatttttggagagagcctatattgttaaggacaagtttaaaaaaatgctgaatcagaagagcctgaaatacaattaccatgaagctgacttaacagttctggaaggcgttttggcccgtggtgacagaaagatctcctctttgatcgaagaggtatataaaaacggtgctatttacgattcctggtccgaacattttaaaaatgatatctggatgaaggcttttgaaacctgccgcctggatgcggatttttatactgtaagggaaagggatttagaggaagtgttcccctgggactttattgatgcaggcgtgtcaaaagaatttttaaagagagaatggcagaatgccgtcagtgagaaagtcacccccaactgccgggaaaggtgttccggctgcggggccatgaatttcaagggaggtgtctgttatgaagttgagaattaaattctccaaacaaggcccagtcaaattcgtggggcatctggatattatgcgttacttccagaaggccatgagaagggctgacattgatataaaatacagcgaaggcttcagccctcaccagatcatgtcttttgcatccccttaggagtgggtcttacaagcaacggcgaatatatggatattgaagtgaaccccgcagaggattggaagacggtcatgagccggttaaatgatgcaatggcagaagggatccgggttacggaatgccatatccttgacgaacgggcgaaaaacgccatgtcactggttgctgctgcagactataccctgacgttccgggaaggaaaacaaccggaggatttggaggcatttttaaatggtctttcggaatttatggaacaggatcatatccttatcacgaaaaagacgaaaaagggcgagagagaagtggatctaaaggcatttatctatgagctttcagttcgcggagaaacgatttttatgaaggtatctgccggaagcgcagataatttaaaacctgagctggtgatggaggcttattatcagtggctgggacagacttgtccggaatttgccctccagatccagagagaagaggtatacggcaatacggccgatgaggaacagcaagtttgggtgcccttggggcttataggagaatcccttgaataagttaatcataacaagatggaacggctcagtcattacccttcttcagtcaggaagggtgacggttcaggttgacattgaaccagaggagagccgccccgttttaggcaatatttatataggaaaggtcaatcacatcgtaaaaaatatcaacgcagcctttgtagatataggaggcgggcagatgggatacttaagtctgtcagatgcctgtatttattttgcagaccagagactctacgagggaaagctgcgccagggtgatgagatcattgtccaggttgagcgggacgcagtaaagacaaaggccccggtcctcaccggaaatttaaatttcaccggccgctatttcgtgctgacctccggaaaaaagcagatcggtttttccaccaggatcacggatcaggcatggaaacaggagatgaagccctacctggaatcaagaaaggaagaggactttggcattatcgtccgtaccaatgcttataggatcccaaaagaagaactggaagcggaactgatccatctaaaggaatccttcaggaaaatgctggacaatgcaaggcacagaacctgctacagccttctttacagctccgccccttcttatttgaccggtttaagggacagccttaaggcttctctggaggcggtggttactgatgaaccggatatttacgaagccgtaaaagaatatctgactcagtgccagccggaagacttaaggcttcttacacggtatgaggacaagctccttccgctgggaaagctttaccggatagaaaagaccatggaagaagctttggggaagagggtctggctgaaatcagggggatacctggttattgaacctacggaagcactggtggtcattgacgttaataccggaaaattttccggaaaaaaagagctccgggaaaccattaaaaaggtcaacttagaggctgccgaggaaatcgggcatcagcttcgcctcaggaatttatccggcatcattgtcattgattttattgacatggaagcagaggaggataagcgtgtccttatggaacggctggaggaaattctgtccaaagatcctgtcaagacaactgttgttgaaatgacaaagttaaatctggtggaagtgaccagaaagaaaatacgaaagccgctttatgaacaggcattgcagatgaaggagaaagtttcattatgaaaatcattatagtgggttgcggtaaggtagggacaaccctcgcggaacagctgaacaacgaacatcatgacattatgctcatcgataaaaacgccggtgttatcaattccataacagagagaatcgatgttatgggcgtggtgggcaatggagcagtttataaggtacagatggaggcgggaattcaagagactgatcttttgattgcaacaaccaattccgatgagctgaacatgctttgctgcctgatcgcaaagaaagccggaaactgccataccattgccaggatccgtaatccggaatatgattccgaaatcagatatatcagagaggagcttggcctttccatgaccattaatccggaaatggctgcggctatggaaatagccaggctgcttcagtttccttctgcaattaaaattgatacctttgccaagggcaggatcgagatcttaaagttccttgtaccggatcaatccatccttgataacatgatggtgagggaagtgctgaccaagcttcactgcaatgttctgatctgtgccattgagcatggcaatgatgtcatcattccaagcgggcaatccgtcatgacggcgggagacaagatttcctttatcgcttccccttctgaagccaacaaattctttaagcaggcagggatcgataacaatacggttaaaacggccatgctggtaggaggcggaaagattacatactacgtggcgaaattgctggaaaactcaaagattaacgtaaagatcctggaacagaatctggagcgctgcaatgaactgagcgagcttctgccaagagccatggtcatccatggtgacgcttccaatcaggatctgcttcttcaggaaggaatcgggcagatcgatgcctttgcctcacttaccggatttgatgaggagaacatcatgctttctctttatgcggccagccagtccaaggcaaagctgattacaaaggtgaaccggatcgcttttgaaaatgtcattaattccatgaatttaggaagtgtgatctatccaaagcttatcacggctgaaaccattctccaatacgtccgtgccatgcagaattccatgggaagcaatgtggaaacgctgtataaaatcgtggcagacagggcagaagccctggaattccgtgtggcaaaagagccgtccatcgtaggaattccattggaaaagcttgagcttaaaaagaaccttctcgtggccagcatcagccggaggggacgatttatcagtccgcggggaaaggataccatagaagagggtgaccgggtgatcgtcgtcaccacggtgaccgggctcaatgatttaagggacatactacggtaggaaaaggcgaaaaaggctatgaataaaaaagttatcatctatgtgatgggctggattttaaatattgaggcagtatttatgctgctgccgtgtattacggcattaatttacagggaaacaagcggtttctggtttctggcagtcatggcagtctgcggaggcattggtcttatttttacacggaaaaagcctgaaaacatggttttctttgcaaaagaaggctttgtttccgttgcgctgagttgggtcgttttaagcttttttggggcattgcccttttatttaagcggagaaatccccttatttgaagatgccatgtttgaggttatttccggctttactaccaccggagccagtattttacctgatgtggagtctttttccaaatgtatgatcatgtggaggagttttactcattggatcggaggtatgggagttttggtattcattttatcaattcttccccttgcaggtggttataatatgtacattatgaaggcggaaagcccaggcccatccgtaggaaaactggttccaaaggttaggacgaccgccaaaatcctttataaaatctatttagccatgacagcgctgcaaatcattcttctggtaataggaggtatgcccctttttgattccctggcaatcagtttcggtacagcaggtacaggtggattcgggattaaaaacaacagcatggctttttatgacagctattatctgcagggagttgttaccgtatttatgattttattcggtgtaaactttaatgtatatcacctgtttttgacccgtcatcccaaggaagccctccaaagtgaggaggcccgggcttatcttggaatcattgctgcttctattttgcttattaccgtaaatatccgcggaggctttggaaacctgttttctgctttccaccatgcggccttccaggtcgcttcgatcatcactacaaccggttattccaccgtggattttgatttgtggccggaattttcaaagggaatcctggttgttctcatgtttatcggtgcatgtgcaggaagtaccggcggaggcattaaggtatcacgaattgttatccttttaaaggctgtgagaaaagaactgggatccctgctccatcccagaagcgtaaaggttttaaagctggagggaaaacccattgagcataatgtactccggtccattaacacatttttaggcgcttacattgtgatttttacagcctccgtcctgcttgtcagcctggacaactttgactttaccacgaattttacggctgttgcagcgacctttaacaacatcggaccaggacttgggggagccggcccggcccagaacttttcccatttttctcccttatccaaatatgtaatgatgtttgatatgctggcaggacgtttggagatattcccaatgctgctgatttttgcaccttccacatggaaaaagggctgataaagaaaacggccgcagattttgaagcctgcggccttttgcgtgtatggagaatgatgctgctaaacttcttttgtgtctctttccggaatccaggtatttccgttatggttgccgcagtagacacccttcttgatcggggcaaataaaaagccaagaaggcagcccaacagaaatgaggataggattaataatcgtttttcggcaaaactccattctctgttaaaaaagattctcatagtcagatctcctttcaactgtttattaataaatctaaggttgataactgtttgtatcataattatgatcaggggaatgatctgctgaatcgctgccgtcagggcattgtggtgcgtcatcaaacgtatccccttgatttatcctgtaaattctattatactaatcatcaaaaagaaatacaagcaaaaaccagattgcaggcggaaaaaacagattatttttatttaaaaacgttgacagaactgtatgtaggtgatatattaatacagtatgccgcacaatgaggtctaaaagtttccatatccatcggaacaccatagttggcgagtaatgataataggaggtgccatatgtacgcgattattgcaacaggtggtaagcagtacaaagtagcggaaggcgatatcattaaagttgaaaagcttggtattgacgctggtgaagctgtcacatttgaccaggtgcttgttgtaaacaatggtgaattagctgttggctgcccgaatgtagcaggtgctaccgtaacaggtacagttgtaaaagaaggcaaagctaagaaagttattgtttacaagtataagagaaaatccggataccataagaaaaatggtcacagacagtcttatactcaggttaagatcgaaaagatcaatgcttaattatgataagagtaaccgtaatggttgattcagaacagcattatacagggattcagatgttgggacatgccggcttagcggatgatcatcaggacggacaggaaattgtctgtgctgcagtatcggcgcttacgtttaatatggccaacagtgtggaacagtttacagaagattcctttgaagtggaccaagaggaaaagacaggcgctttttgctttcgttttacttcagatattagttcaggatcacagctccttatgaattctttgatattcggattacagaatattgaagaggaatatggagaaccatatattaaaatccgatttaaggaggtgtaagtaatgttaagaatgaaccttcaatttttcgctcataaaaagggtgttggttctaccaagaacggcagagattccgagtctaaaagattaggcgctaagagagctgatggtcagttcgtattagccggcaatattctttacagacagcgaggaactcacattcacccaggcatcaacgtaggccgcggcggtgatgatacattattcgctttagtggatggcgtagtaagatttgagagaaaaggcagagacaaaaagcaggtttctgtttatccaaaagcaattaacgaataattggaccggcttcataccttaaacgtatggagccgtttttatgatacagggactgtccggccgcctgtatttaaaaattcgctgctcatgctcaaattagggttgaaccctttaagaaaggggcttaaccctttataagaaagggttgaaccctaattttaaacaaagagaaacgtcctgcaggcatatctttatgcctataacacatgggcaggaaagaagaaaagccctgcaggtatacctttatgcccagaatgcatgggcaggaaaaaagaaagggaacaggtgaatgaatgtttgccgatagagcaaaaatatttataagatcaggaaaaggcggtgacggtcatgtcagcttccggagagaactttatgttccgtgcggcggtcctgacggtggtgacggcggccgcggcggtgatgttatatttgaagtagacgaagggcttaacacattaagtgatttccgtcatattcacaaatataccgcacaggacggagagtcaggcggaaaacgccgttgtcatggaaaagacggcggagatatggtgatcaaggttccggagggaacagtgatcaaggattttgaatccggaaaagtcattgccgacatgtccggagagaaccgccgggaggttattttaaagggcggtaaaggcggccagggaaatatgcattatgcaactcctaccatgcaggctcccaagtatgctcagcccggacaggcttcccaggaactttgggtacagcttgaattaaaggttattgctgatgtgggacttgttgggttccctaatgtagggaagtccacgcttctttccagagtcagcaatgcgaggcctaagatagctaattaccattttaccaccttaaaccctcatttgggtgttgtggatatagatggtggaaagggctttgtgatggctgacattccaggccttattgaaggcgcttccgaaggcgttggattgggacatgattttctccgccatattgagcggacaagagttctggttcatgtggttgatgccgcatctacggaagggagatatccaattgcggatattcatgcaatcaataaggagctgggcgcatataatccggaactgttaaagcggcctcagatcattgcagctaataagacggatgcgatctatgatgacggtgaggatccggttgaaaggcttaagacggaatttgaacctcagggtgttaaggtttatccaatatctgcagtaagcggcaagggcgtaaaggaactgttatatgccatatatgaactgcttcagactgtgaacttaagtccgatcatatttgaaaaagaatttgatgtaaaaaatctgactgatgcattgcttccgtatactgtggaagtaacagaggatggggtatatgtggtagaaggcccccgcattgaaaagatgttgggctatacgaatctggaatcagaaaaaggcttcagtttcttccagaagttcttaaaggataatggaattttagaagagctggaacaggcggggattaaagaaggagatacagtccgcatgtatggtcttgaatttgactattacaaatagtacgaggagaataatatgacaagtaagcagagatcctatttaaagggattggcgatgaatatagatcctatcttccagattggaaaatccagcctgacaccggagattaccaatgcggttgcagaagcgctggaggccagagaattgataaagattactgtgctgaagaattgcctggatgatggaagcagcattgccggtgtattggcagagaggactcattccgaggtcgttcaggtgatcggaaggaagattgtcctttataagcaggcgaaagaggaaaataagaggaagatcgttcttccgaaataatcctgtttcgtttatgagtcagggagtcgaatattatgggtaaaatcggcattatgggtggtacgtttgatccaatccacaatggacatttgatgcttggtgaacaggcatataaggaatatggcttaaaggaagtctggtatatgccttccgggcatcctcctcataaaaaaagccgcaatgtaacagaaccggccattcgtcttgctatgacggaacttgctgtgaaagcttataaaggctttgtttgttcggattttgagataaaacggaccgggtatacgtatacggcacagacattaagattattgcatgaagcatatccggagcattccttttatttcatcattggagcggattctttatatgagattgagaactggtatgagccggacctggtgctggctcaggcggtcatactgactgcctggcgggaatatgaggaggcggaccgttccatggaacggcagatcgcttatctggcttccaagtataacgcggacatccgcacgcttcactgcggggaaatggacatctcttccgcggagctgcggcgcatgatagccagggaccagtcaatatcagactatgttccgggtgaggttgtggcttatatcaaagcccacggtttatatcaggagttggaacaatgaaagatctaatcttagagttaagaaatgatttaaagggaagattaacatcttccaggtttgagcatacaatcagtgtatcatttatctgcactgcattagcaatgcgttatggctgcgacttaaataaagcggagcttgccggtttgctccatgactgtgccaagccttatggagatgatgagattatcagaaaatgcaggaaacagggtcttccattaactgacgatgaactcaaagccccagtggtgcttcatgcgaaatatggagcatggctggcagagcataaatatcgtataaatgacgaagaaatcataaacgccatccgttggcataccaccggcaggccggagatgtcaacactggaaaaaatcgtttttacggccgattatattgaaccaaggcgtgacagggcggccaatctgacgcttgtacggtcgatggcatttgcagacttagacgagtgtgtttatctgatccttaaggatacattagattatctggcaggaaagggcagttttgtggactccatgtcaaaacaggcatatgcttattataagcaggttcatgaagaaaagaagggagagcaaggatgaatcagtcaattgagatggtaaaaaccgcttatgcggctttatctgataagaaaggtgaagatatcagaatcattgatatacacaaagtatcagtaatggcagattattttattattgccagcggtactaatacaaatcaggttcaggcaatggttgataatgtagaggaagaacttggaaagaagggattcgtctgcagacaggtagaaggctatcagtctgccaactggatactcatggattacggcgacatcattgtccatgtatttgaccgtgataatcgtttgttctatgatttggaaagaatctggagagatggaaagatgattgaagctgaggatttggaagctttatcatagtttatcacaaaaactgaatgaattaggtaaaacggcttaacagaacctgtgagccgttttttttgatccattggaaattcattcaggttctatggatccggcataaatggatgttccgatatgaatgtgcattcggctgcccaatccgttcaaatgcagtatgggcagctgaagcaattgtgttcggcgcaaaaaaatgccttgcaaactctttattcctaatttttgttattctggatatttatatccctggagtttgcataattttattatgtaaactccaggggaggtaatcaagtctctctgaaatttcaatgaatccctaaacggaataaaccgattaccttacccaggatttctacattatcgacaatgatcggctccatggaatcgttctccggctgcaggcggtaatggcccttttctttaaaaaaacgcttcacagtcgcagaatcttcaaccaatgccacgacaatttctccgttatgggcggttggacaatgttcaacgataatctgatcgccctccagaatacctgcattgatcatgctgtttcccttaacctttaacataaaggtctctgcgtttggaagaaggtcagacggtatgggataataattttcaatgttttcttctgcatatagaggctgtccggctgctacagttcccagaagcggtacatttacaacctcccggcgtgtcagctgaaagcagtcatcaatgatctcaatggtcctgggtttggtgggatctcttcttatgtatcccttttcctcaagagtctccaggtgggagtggacggatgaagttgatttcaaacagacagcttcgcagatctccctgactgccggcggatagcccttctttaaaatcgtctcttttatatattctaaaatttcctgctgctttggggtaattctctcttgcgccatgacacggcctcctcaatccttattaattaagactatagtaacatatgttcgatgaaaatgcaaacctttgttcgaaaaagtgcaaaaccaattgacaaacatatgttcgcaatggtatgataagaacataaaaagaacagatgttctgccgtgaattgttttaaaggaggtatgcatatgataaagcaattgattgcattgtcactgattgtttttctgggttcccatttttttggtcattccataatgaatgccctcgccggagagacggaagcgccggcgatggagaaatattacaccagcatagagattcaaaagggggacagcttatggaccattgccggatcttatttagagaacagcgggatgactactgcccaatatgtgaaggaattaaagaacatgaacggattaaaggaagataccattcatagcggacagtatctgaccgttatgtattttgctcctgattctgattcaggagagagatgaacaggattttatagattttgttgattttattgaggatatatcttagaataatagaagcgccgtctgtttaagagacgtttttaatctcagaatgattcttataatcaaaggactcaatataattatgaagataactttcggaattctggcccatgtggatgccggaaaaaccaccttttcagaacaggttttatatcgagaacgggtaatcaggaccttgggccgcgtagatgcaaaaaatgcatatatggatcataatgatattgaacgggcaagagggataaccatattttcagatatggcctgctttgttcatgacgatgatacatattatctgatcgatacacccggtcacacggatttttcagctgaaatggaacgtgccctggaggtaatggactatgcagttctggtcattaacgggacggatggcattcaaggccatacggagtctatctggagccttctggagcgttataatatcccgtatttttatttattaataagcttgacgtggtttcagcatcttatgaacgggttttatgggaagttcgggaacgattttccgataacatcctggattttcaaaacatgcaccttgagaaggggatagaaggcactttaacagatgatctgattgagaatgtatctgaatgggaggaggaattccttgagaaatggctggatggaaccattacccttgaggagctaaggcctgctataatttctcagattaagaatcggagattattcccctgctttggcggctgtgctttaaacggagagggaatagaacagtttctcaatgctttttattatttaacagaggcttcctatccaacatcagcaccttttagcgggagggtatttaagattcgttatgatggacatggggagcgaatgacatatttgaagatattaagaggctttctacgggttcgggattctctgtctgaggaagagaaggtccatcagatacggatttttcaaggagaacgcttttcttccattcaggaagcttctgcaggagatgtggtggccatcaccggaccgcgggcaacaagggcgggccaggggcttggagaatgccatgaaatgatcttcccggtgcttcaacccacccttcaggcaaaggtcttatatccgcctgaggttcctgacaggacaatcctgcagatttttcacgttttggaagaggaagaacccgcgttaagtgtagtatgggaagaatctttgaagcagttaaaagtaaatatcatggggaaaattcaacttgaggttctggagcaggttgttttagaaaggtttcaaatatcaatatcctttggacagcctgaaatcatatatatggaaaccgtagcagagccggttacaggatatgggcattttgaacctctccgccattatgcggaagttgcattgaggatagaaccaggtgagagagggaagggagtttcatttgagagtcaatgtcatgtagacagacttgggattaattatcaaaatctgatacgtactcatgtttttgagactattcataaaggagttttaaccgggtctgaactgacggacgttaaaatcatcctggttgatggactttctcatatcaagcacacggaaggcggtgatttccgggaggcggtataccgggcaatacgtcagggtctgatgaagggcaaaaaccttcttttggaaccttattacagctttactatatcggtttctgattccttaacgggaagggttttaaatgacatcacaaaatattccggccggtttgaagcgccggttccggatggaagaggaagaacggtgattaagggcctggctcctgttgcttcttttatgaattatggagaagagctgatgatcatgacaggagggaaaggaagtatttctatggtattttctcattacgatagatgtcacaatgaagatgaggttcttaaccactttcaatataatcctaatgaggatactgataatccttcatgttccgtattctgcaaaaagggaacttcgtttgtggttaattgggatcatgcggaagagtatatgcataccctttcatgattgttatcatctgtcagattgaatcttaggttataatagagtgctgataagacttctgaagccaaaagaatctttgcatgggttttaagaagattttatcgtcaaacaagcgtattgttccaagtgattgatacgcttgtttttttgtttatcctgttctcatagcagttaaccattatacaaccaagaacacaagagagggaatttattgatgggagaataaggcagatacgctgaaaatctcgttgaccttttaggtaaacaagagtataatggaattaacctaacaggtaaacgaggggaaggataattatttatgattataaaattattagagttagaacctctaaggcttaatgccatcttaaatgccgcactaaaagaatttacacttaaaggatataatgacgcatctacaaatgtaattgcaaaagaagcagggatgtctaaagctttgatgtttcattatgtgaagaataaacaggaactttttctgtgcgtatacgactattttgctgatcttcttgataaagaatattatatgaaaatagatttcactgaaaaggatatttttaacaggctacgtcaatcatatattcttcaaattgaattactgaaacaatatccgtgggttcttgagtttaacaaactttctgctgcagttaactctgatgaagtaaacaaagaacttgaaaaaagagcccttaaaaagcaaccttcatgttgtactcacatatttgaaatgattgatgagtccagatttagagtagggttggatgttgaaaagtgcaaacagtttattctttgggccaatgtcggatttactaatgagatattagatgatattagaaatacagaatcttcggcattaaataatgaactcattattggaaaacttgatggatattttgaggaacttagaaaaatattctataagccaagcaagaaataggtaggattgacaggggcaagaaggatttaaaactacatctaattgtataggtcgtagtttgtgtgccaaggtatgctctgaacaaaatataagaattggtgtacacgatatcaaaatcctaatgttaaagcagaaaatagtatcaacagctaggaggtgtggaatgatggaagcaggtaaacctataatcgtagaatttcctttgaggggagagtggctttctcctaatactcctggaagaagaattcccagccatgggacagaccgattaggaacaaggtatgcttatgattttttgcaagtagactggaaaagaaaaggttggccaagctatcgtattcactggttccagtatcttatttttggagtttctttaaacaaatgttattgttggggacaagaagtatatgcgccctgtgatgggataattgttcacgccaaagatggttataaggaaagagccaaagcacatttatttgcagatatggttgttgcaataaagagtgcgcatacctttaacccccaaaaagacaatattcagtcccttgccggcaattatatcattatgaaatgtgaagagaatatatatgctggatttgtccatcttcaaaaaggatctctaatggttatggatgggcaaagagtgaaaaaaggcgatgttattggtagagtaggtcattcaggcaactctttttcacctcatttacattttcagcttatggatagcagcgacatacgttcggcaaatggactgccctgtgcttttgagcaatatgaattatttcttgatggagaatggcataaagtgtttaacggcattcctacagataaagatagaataaggttcaaaaattgatcctaaagaaggaggagtgagggtcgataaagtccattttaatcaaatggtcaacctgccacggcaaatatcatgcccgtatccgtgaccggaattatatggtagaccataagtactatcataaaaaactccgccattttcaaatactggttcacgcattctaccatatgttctgtaattacggaaagaggttgaatcaaatatgtatcagaaggtattctttttaccgcaagagcaattggagttaatggtaaaaaataatctacacctgtaatttcctttacgattactggattatcagtaagataatatttttttgttccggaaccttataagtttctataggagaaatttctgtcatacaaatcaaaaacttgacaattgtcagatttatactataatattaattatatgctattttaaactctatgtgatttattaaataataaataaaataagtttgtattaaagaaataaattcaaaattaattctagtataacttatttaaaatacttttgctttgatacgtatattttcttttgacaatttgtgttttgttatgttaaatcacattgaaatttaggtaacaggttttcatcattgaatcataagattttagatgattgccataatataattataaatcaaggaggcttataactatggaaaatactggagttatgaacgttgagttaagaaaaagtaccagaaagggtgacaataatcagttaaaaagagaaggatatttactgggaaacatagctggtaaaggtgttgattcaatctcaatagctgttaagaaagatgtatttagaagatcaatgaaagagtttggccggaatggcatttttaaactggttgttcctgatggccagagttataccgtaatggcaaaagaaatacacattgaacctgttaaaaacgaaatctctcatttggattttcaaatggtatctttttcggaaaaaatcaaacaagaagtggctataaaaattaccggagcagaacttcttgagtcaaaacgattgttgattaacagtaccatagattcaattttactggagggcttacctcaggatattcccgatgaaatagtaattgatgtttctaatatggaggctggtgaaagtattcaatttagtgatattaaacttccggaaggacttacctcaactattgatccggcacaaaaaatgataacagttgttggctctaagatacgtgaagcagttgaaggtgaagaagaggccgaaagctaagaggaataacggcatttacttttcgtatgaaaatattataagagcctgatgataaaggtgaaaaaagaaagctctaatttagatattagatgctttctttttttataacaaaaaaatcaaaaagatagatagcaacttcccattatatttatatcaggtccttacgtacatgtgtcatgtcctcttacataagacacatgctcgcagaccattcgccaaagccttcaaagttccccaaaagacaaaaaggaatccgccagggatacttaaatttcccgtaatttcaccttgtttcgggcgctgcggcgacgttcatcctccaaagcagcatagtgtttctttgtggtgttgacgtcagagtgtcctaaaacatctgcaaccagatagatgtcacctgtttctttgtacaggcttgttccataggtgctgcgcagtttatgggggtaatcttttttaacggagttacgagtctggagtatttctttaccagattttcaacgctgcggactgcaatacgttttttttgaagagatagaaagagggccttttcatggccgtcttcaggaattaccagacttcgttcttccaagtaatccaaaagggcatcttccacttcagagccaaaatataccgtgacttcctttcctccctttctgtggattcggatcccaccattttttaagtcaatgtcatcaatatccactccaacacattccgatacacggattccagttcccaacataagagttaaaagtgccaaatcacggatcttggtttttgcgtgataagccttttgtttctcagttaaagcttctccactttccacttcatcaagcaaaagagcaacctcgtcaatatccagccggataatatccttttcatgaagctttggaagctgcaccagagcagcgggatttgtttgaagtcgttcattccggaaataataattatagaagcttttcaaggaagagattttccgcataattccccgctctttgttggttacttcctgattcttatcattaaaacgatattttaaatactccatatattcttctatatccacgacccgaagggaatccaggtgttctaacgtgatatcctgaacatggagcttgctgataacggggttctccttaaccagaaagtcaaaaaatacccttagatcataagcataagcgatcctggtgcgggaggaggtgcgaggttcaatccctcggaagaagtctccgcaaaagcgaggaagttcttttaccagctggcgcaggtgcttaacattttcaatatctttttgctgatgataggagagaggagcactcataattcgacctcatttctttttatatttgattaatgaccttactaaaagtccggtcatttgagatcacttttccggacttagtatggcacatgtttgtgtcagagtctggtacagagaaagtaagatcccaggtgcagatcacaatatgaaacatgcatagcataacgtaagataagaaaaacacaaattgagtataagtgataaatttccttatgtgataatattaaaaatcaaataacagtattcatgttttctttgccaactattcgttaaactagactttcgcgaatagtttaaactgtctgtattaatcttaccatttctgcgtttctgtgtcaaatccaatttcccctgtagttttggggtcctcatgaaatttaaacgttgttgtttgtcgctgctactttctttttgattgatattgtctgtgctggtttcttctttagctgacctgggcactgacatcaggctgtatatgattcttacaatgaagccattcaaccaagggctttttagtatctcgccttttagttctattccatctgtaactaatacgattaatcgtggtctggaatcatgatgatttgttctcctggttctcggatcggcttggtttcctctcctttcccattgatttgttggctcagcttgcggaaatgtttctcggctcctcttccactgattttgttgtcacactcttcaagagtctctgttatctgtctggtggtcattccttctgcatacatagaaataattttctggtcaatatcagatatatctttctgacgtttttttactacttgtggttcaaacgtagacttacgatcctgagggacgtcaatcgtcatacttccgtaacgactgtttacctatttgcctttataaccatttcgataaaatagaggattactcattaaaccatgccctgttattcagaaattgccatggacggctatttcctacgctttcttgaataccctaaaaaagtctgtcttaccaattgatcttctctatttaaatggttttcacttatataagctaataagatccttcacaaatatttcttcatttgtaatttgaattttattattgcttaaaaatccatccaatgattggattgttttctcgataatagaaattttccattttttgcttaaatcttttttaaaactaatataaatttcattttttaatggttcatatactattgaacacagagtatcctcctgactagttttacttaaaacttcaaaggcttcatttattccaaagctatgaatattattatgaatatattcatgagcacaaatatatctatcagcacctctaccatatactttatgataatttgattccttaaaatccccatttggaaaattagtcataataataaaattattgtgactaggacttattatatttgtatcatttccttcttccagaataaatgcatcaccagttttatcagcgataatagtatgtagccctaaatctgggaataatggatttctaggatacgagattactcttttattaagaatttcaaaaaattcagatgttttttttgttttctttagcgcctcatcaaaaatatcaaaagcaaaccaatcattttcgttacaactagatttaaaacctggactatattctactgcttgagtacagataaaaagacccttactattaaaaccagcgatatccctgtatttgttatctaataagcctgagaagtaaaataagtttatatcattataactagtgactttaagttttaaatcaatatcatcagcatcgaaattcataccataaatagctttttcttgactgtatactgcaaaacttgtacacattttggaacccccttttaatatataattttgtcatataatatgcttagagtatttagagaatcatttagctattttaccattagcttcaccactttcttaaacttccatccatatgatattactagacatctcgatggttcaacctacaacattttcagaatcaaaaatgcgccacttaagcttatgctttatgacgcattttgttattcgttgccttttttcatttcaaaagtaattttctgtatacttttgagagataaataatatatttcagaaagaacttttgtagatataccctctttatatttcatataaatgtctgcgtttctaattgaagttccccttttacttctggttgtttcgcaaaatggatatagaattttcaattagatatccattttataccttttaatatgtgtttattatatcaaatttatattcaaaaatatagcaccataattccatatattagtatttagtgataaataataagtcaaaaactataattatgttttcagagccaattaagactcagacataattgaatttacatggcatcttttaaaaccacccttatagataacatcgggttcaataaagaaaaggcaccaatcatttctgactgatgccctgtaatgcgctctggttgttaatcttcttttcttatttatttaagaagcatatctttcttatcaataatagcttctacagctgcgcaagccggacaatcacaatattttgctccggcagactttatttcctttgcatgtgctgtgatatgcttagcagtgtctgctccaaaaacatgaattccagcatcagattctgcaaaaccgattaaaccgtcaatcggcataatatctgcctccagctcatcaatatatttttgggtttcttcggtttccttttcagttccaattgcatctaaccaagtctgagctgctgattttgcttcgctgctgcatgacggagcatttattaattcgtgtgttttttcaacagcataatttaatacttctttatccataattgatattccttctttcttctggattttttctatattctaccataataattgagcgtttgcaattctaagatgtatatgaacagttgcttctgccgtctgtatttgtattttaaaattagtctctcaacaccgctcctcttgctattcttccagtgtcttatctttaattgtaccccctattcacttcagattaagccctgaccatcaaataaagatgaatttcactcccccactctcctgctcatttacggctattttataatcattattctgatttttttgagccatattattgtttaattcttatcaatatgcaaaattgtatttaaaagtacattagctccttttaaacagttttccaccggagtatattcaatctcacaatggctatgccctcctacactcggtacaaaaatcatggtagttgggaccagatctatagtaaactgggcatcatgaccaggaccgctgtatattctccgattggagcagccgagttcctgtgcactgatttccacataatcaaccagttcggtagtaaagcttacggtattacgtgaccatgcttcttcatagttcactttgcattgttctacaacgcctggaatatttttaataactgcaactacctgcttgatcacatcaggatcctggtgcctcgcatccagggtaaattttacttcatcaggtattatggtgtgaatattcggatgggcagatatttttcctgtggtataaaccaatttgccatctaactggtccagctcatcatggagatattgaatggtttttactgcagcatatagagcatccttacggtatttcataggtgttgttcctgcgtggccggcctgcccggtaaaagtaaattcataattgatcatgccgcagacaccttctactactccaatatcaacaccttctgcttccagtaccgggccctgttcaatatgaagttccactaaagcttttgttttagacggatccagccggttttcttcctttcctttaaagccgcttttttccaaagcctctccaaaagtataccctggaatatcttttgcctgtgaagtcagcatggtatccttattgaattttccacaaatgacaccggaagacatcattgccggttcaaatctggcaccttcttcgttggtccatacaataaccgtaatcggatgcctgtgaggtactttttcttttactatggtttctgccacttccattgctgttaagactcccagaatcccgtcataatttccgccttgccgtacggaatccatatgagagcctgagacaatggcaggcaaatcttctgttccggcaaaggttgcatatatatttgccatatcgtctgttgcgatggaggcaccgatagcctccatgcgctttacgaattcttttcttgcggctaaggcttcatctgataaagaaaatctggtaattccgccttttcctgtatcaccaaaccggctgaaagttttaatcttttcttccattctttcataattgcactgaatcatgttatttgcctcctattatgtacaacttatttaaaattactttttaaggatttgctgattgtcaaatgaaatattgctgcttatatgatgcaaatcaatataaaaatttattattttatctatggattgtggagcataagctgttcaaaattatacttcacatattttatgtagcaatatgaaatgcaatctcttgcctttttttattcatttgaccgtgtaatctatgatcgctttatgctgctcaaacacctgggacctgatgctatagcaaagtacctgataagtgcctaatacttcaaaacagtaaaatataatgctttatacttccccgcttctattatttacaaataccatcataacataaggtggaatatattacaaatttgggatcgtgaacgttatgtgaagaattcggtaataggagcaggaagcgttgtaacggatgatattccttccaatgtagttgctttaggtgtgccatgccgggttgtcagagaaattgtggagaaagacaaaaagtacttttttaagaatagagagttagatgtatgggagtaatatgagaaagaaataatggccgcttcagccaacacctgttggcgaagcagccattatttacattgacctgataaaagattaagatcctaatgcttattgaatccataccccattgctgtcaacttgcctgccatctggagtcatggcgttcatgtataatgatccacgggaacgggagtgaccttctggttttttatattcccattttccctcattcagcgtccaaccggatgaaccttcggcctgcggggtgaaataataccatttttcatcaatacagatccagccttcggccatcttcccggaagaatccagataataccagcatccatccatttgatcatagatccagccagtctccatggcaccatctgaccccaaccggaaccatttcccattgtcgaaaagccagccggtcatcttaacgcctttatcattgaaatagtaccactttccgtttgcttttttccagccggagacttctgcggccgaatcagagcttccctcttcattcaggcttattttccggaattcaccggtaatatatgtatcttgctgaagcaggaactcatatttgccggttttatccggagacacattctttccattaacagatagatgtctcaatcggtatccaatatcaggaactgctcttaccatcacttttgttcccttttttccttctgagatatttgcagtgattctgccgccctcaaggctttcatctgttgacacctggaagcgctcttcttcccctccattgcttcctgttatgattaatgtcaccgttccgttatccgtcatcacaaaggaaattttattccttccatgatcctgatatattggtaattgcctctgttttccatccgacccattaaaaattgcaattattgaattccagttatttccctgctcaggaatgtccatccacactttcaccggagcggttaaggaaagtggccttctggttccatgcttatcctccagctgcagctgaagctcgaaagatttacgatattcttcttctgtttccgatacactgctgtctatgactgacataactgccaaacggacttcctgatcatcatcctcatctgcaaagatcctgaaagcggatgagggagaggctttggctgcatcagaggcagtcgctctgattgcattggaaggacttgcactgctttccgtgattttaatgggtatgcttaacgccgctcctgcaatttcaatgccagtcattccagtctcagtggtatccaccatgctgtctatcatacagtcatttgcggccatggcggccttatacagctcttccaatgtgattagctgattcatcatatactttgccaattcctcattggaaacggcggtcaatgcattaactgccgacctgatggccttttgtaccttgtaattgctgtaatcatcgttgcttaatgcttctgataccgcattttcaataagggactggactttttgaatgttcttcggcaattctgtctccgattttccgcctaaagagacaaaggcctgaaaagctgtcccattttccagttcagcagttacctttaaccgggtgttttcttcgtaatcgtcaatctcaaggcagccttccccatcaatgccggtacctgattccagtggtttgtctccttcgactttccaggaaatattccctacgtcattggaataatcattgactgcaaaggacatgctttgcccgggagcaagggtaactgcctgaggatacagggaagcagccagctgcattgttgcataagagctggaaccgttcgtcccttttgcctgaatagtaagttttgctccatattctgtcagttctgctgttacgttttcatctgatgaaaggatttccgttactggttttttgatttccaccacaatagtccctatatttttcatcgttgggtcagagacagaaacagtcagaattccattctcatcttcttttgccatcaaagaggcagcgcccttgatggataagtctccaattttcgcagcagaatctgtccagatattagctccaagtatattttcggctctgctgtaaacagcctgcatttgaggagtgttggtcagtaccgtgatttgtggttctctggagtactcctgggtttcttctgaggtcatacctgggagaagaacatactcataggcagcattttcaggattttttccgtggtcaaaccacatttccagatagttctcttccgcttttccatttgatgttcccaccagcgaccagtctccggcattccttgcctttcttaccgatatggtttgagaaccggaggggaaataataaccgatatcacttccagccgtatttccctccaaatgagcccatgaaacatcagaaagcgttgttcctgacacatctacttttccttctacaatatcttctaaagatgcggactctgtcataagatcttttttctctccgttgatgatcagagcattatcaccctcctgcctcagacgcctgttttcaataatgctttccaccggatattcttcaccggaatttgtaataccggcgccaaggcatacgatctgttctccaagcataaaccaggattttttacctgacagatgaggagaataagtcacagcaggagaaccctctccctccttgacccgtacctcgccggttaaggacattccgttaattccgtcattttctatggtggtgcctccgacccaggattctcttgaacggaaatcgccgccctgggcaaagcttgaactgtccggctgaccattgccgatattcttagaaacaagggtcgttcccgccagacgtaggggattcacagtattccagaaattttcagtatactgcatggtgtcctgattgtataagtaggtcataccgcttccctgatgccagccatagcggttttcatggttcatgatttcagtattctgaatacgttctgaatacatggacagtgccatgagaaacttatcggtacggtgaatcgcccggtccatgagaggcaggtttttatgtatcgaagcaatggaggtcgtgatggaatcatcctccagaatgtccagggcctttgcctttatcattatatactctgctccgcttaaggtttctataaatccgggatcaatttccatccaggcttttaatgaactttttaattcatcctgtacctcaatggaaacggaatccataagctggatcatgagaatcattgcttctcttcctgaatcccggttactgccggctggtctggatacagaacgtcctttcagggaatccagcatcagaccgtcatacattccattcaaaaatccttcttttaaatagaattccagattttcctgcacttctcttggatattcccatggtgttccggcaaatagcggcggcatacctgctccgcctttaagaaactcaataccgtaggatcctaaatatggcacatgagaatggtccagataagaaccgtctgcataaaaaccgctgatatagccctgatctgctatcttggtactgtctttcaggctctgaatgataaaggtctctgaagaagctttttgagccaggtaaacaagctcattatcttctctgagaattcccagccctaaggcgatccttgaacagtcaataatattagctccctgggccgtccggtatccctgggcatgggtgcttccggttccaatgatgccttcatgataaggatccggctgaaagaaatatagtccctcggtataaaggctgatttcttcctctgtcagctggtcatataaaaggactaatatgggaattaagtctttgggaacgccgatttcccatgtccaccagttatctgtttgggtttttgatgagtaacagcgggaacacaggtaattcaggatctgcttcatatcctttaacagctcatcattttgatagtaaaggttacccttggctgcatatgcctttgccattgccagcacctttttaaaggccggacgaaactctaccgcatcatcctcaaaaggaatgtccgggttgccggcagctccttcatcctgcggccaggggattttgtcacaggagttctgtcctttataatcgtatgcttcccaggcagattttgcctgagcttgaatgtcgtcaaggatctcactgcccccatcaagttcagttaagtcatttccaatgagggaatccttccagcgtttgcggataatctcgtaatcttccggttctgcctgaggcagatttgccggatcttcataaaggactgtgacgttccactttttttgttttccgccttcatcagtggccaatactgtgacgactcctttttcatttgccgtcagcagtgcaccttcatcggaaagctttctgacagaagcaatgtggcttccatcagtatctccggcttttctggttccatccgtttcgccttccagcagttctctcttaattttactgcttcctgcattgcgtacatagttcccgtcacctttgggaattttaacttcccactgtatgctgccggacaattcatccggtttctcgatcctgccttcttctcctcttaccaaaacaatcgcatctccagttactgtttccgcagcctttccttcaatcgtcaggaccacaggttctgttcccattttggaagcatcaaatttaagggaaatctgggagttaaaagcagattctgctaatgccgttgggtttgagtttgttaatattcttgttccacgggtttccaatgttacctccggataaccatcgttctggctgtcgggttttgctatatttaaggttatgttgccggtagaaggatccttttttacagtaagtgccatacattcattcattgtcaatggcactacctgattatccagcctgatgctgccggaggaccacttgtttacagatacaatcccctctccggtgctggaggcggcctgtatctgcggtgtattcatgagcagccttgcatctgttctgtacagacttgaattggaataatcggaggtggtcttacccgcgaccatggtatactggtaggtctcccctggcgcaataaaaaattcggctaaccgggccttatcagactcttttgtgttcaaccgataatatacgttagaggcagaaagatgggatccagtctctccatctccaaatacataggaccattccagcttattatcagataaagcagatgcgctgagccagtttctctgggtatggactcctttggtcggagtattgatgagggagctccacactccctggtttgcacttgctgtcagtacattccggtatccgttgctgggatttgtcaatgccagctttgtatcctttgtaaccggaatgttatctacaatggttatgatctgcccgctattttctgtttgtgcctggaggcctgctcctgcacaaaggatttcgctgccaaataaaaaccatgactttactccatgaacctcattccccagcttcactccttgcacaccgtaggtttctgaaagcgacttcattgacatttctgttgcgatttcggcccctcgaaaatggttttccccctcccagaacatggttgttccaggtatcagtgcttcatccatggtgttccatgccgaagccgtatcgctgttttttgatagtgacagactcccccctcccactgtaggattaatggccgcagcgtaatgccctgtgtttaatatttctgatccggatattttgggtaacgtctgtccggcagctggaactgtaatgatcatctgcattgcaagacacatgcttgtcactcgcttccatttgttcctaatcttttgcttcacacaaaattcctcctttttattaaagtaattatatgaatgattttcctgattttcttcctcttaaaaggaatgtacatgttccataaaaacagtcaaagtcataatataaaaatttatttaagtatatggaattttttgacaataataaatgaaatatcttaaagataattgtaatattttaatgtttttaataataataaatttaattttatattatttttgtaaaagatgtattatttgtggaaaagactttttacttcaaaacaataaaattgaacacgtcatacttcctaaacattagaagtataacgtgttcaaattctgtttttaatattttagatgaattttcggcatgttaatatcatcattaaatcttttcgatttaaactttctctgatttttctataagaaagcatgtgggcgattttcatcttcagctatttgtaaataaccatttctcaaaagctatagacagttaacttcctgggtttttgcagcatcatttaaaaatttaacgccagcatgaaaatattgataaaaccggaattccatctccaaaatatgaattccactaaacccttccaataaaggcagcaccgatccccagggtatctcaccccaggcaggaggcagatgcaaatccccgattccttttgaaaaattatccatataatttttcatttcaccgtgttttccgaaattatcatggacatgaaggtgcactgccaaagaagccatcttacggatatccgacacataatcccggtcatagtttatggccgacagataagcatggccgaaatctaatgtaatcccacaattgtcacagcctatcctcttaatatgtgctgctaaattttctggatttactcccagcattgtccggaatttttcaatatctccggagtaatacggattttctatgccaatccggatacctccggcatactgggctatttctttataataatcaatgtcctttaaaagactgtcttcatcttccactcctatgggactggcatggacagttatattctgagccctgatttcttttgcaaagtcaatacatgacctaaaaaatgctatactttccacctctcccatggaaagagaatgaaagctatagggcatatgaatggagtaggtaaaatcataatccatcaaaatatgctttacagccgaaaccctcggctccaacagtctgccgtttaggagtacatccatggaatgcataatcagttcacagcaatttcctcccgatttccgggccagttccaggcaataccgcagtttcctgtcatcgccgtctatccagtcggcattcaggccaatcccaatcagcttattcacgtcctcatctcctatataaaatatataaacctcaagcaagttttaaggcttcaagggaactttaaaaaacgagtacttttgaatgcgaagccacagcctttcaccggcttcaaattcctcatccgcaataacggtcaattccaaacccggttccgcctcgaccacacagtttacacagttgccccggtatgccgcacttttcatagtaaccggaaaagtcccttctttttgtttgcggtcaagaagtgcatgctccggacgaaaacatagcttcacatttcccgattcctgattaccggtgctaaggggtaaggtttttcctgaatgagtgatgaaaacgtcatttgatatagttccttctataaaattactggtgcccacaaactgtgctacaaacggattcgccgggtttttataaatctcctgtggccttccgatttgctgtacaactcctttttcaaataccgcaatccgatccgaaatttccagtgcttcttcctggtcatgagtcacatatacaaccgtgatgcctacctggcgctgtaaatcctttatatccttacgcattttaatgcgcagctttacatccaggttggaaagcggctcatccagcaaaagggcctggggctgaatcaccaatgcccggacaattgccacccgctgctgctgcccgcctgaaagctggccgggatgccgtttttccattccctccaggccgccaaccgacaatgcccatctcacacgttcatcaatggcattttgcggaagctttctcatccgcagtccgtaagcaatattttcataaatagacatatgaggccaaagagcatagttctgaaatacaaagccaacgtttcgttcccacggattcaaagaagaaatatcctttccatcaaaagaaatatgtccgccggtcaactcctcaaagccggcaatcaaacgcagcagagttgtttttccacagcctgaggaccctaataatgtaaaaaattctcccggttgaatattaatatcaattccttttaatacttctactttaccaaatttttttaccacatgatcaatttttattgatgccggtttcagcgatatattttcattcataattccactccttagcctttctcctgaaacttaacattttcccgtcccatcttgcttaaaagatacatgggcacaaatacgaaaatcatcagcagtacagccatggaggatgcaatgccaaaatcagtgttggctgacatagccttttgaaagataaccacaaccatgttttcccacggcggcctgtatagcatgatattggtgctgaactcagtcatgatctgtgtaaaggccagggcactgccgcttaataccccgcccatcatgagcttaagggtaacatcaatgaacaccctgcctggcctggcccctaccattaacgctgcttcctccagggaaggatggacctgatacagggcagcttctgcgtttttaacggaaaactgcagcttccggataaaataggacaatactaaaatcatccatgtgccggtcagaacaacaggcggtttgttgaacacaacaatgtagccgatggccatggtcatcccaggcaccacatagggaataataattgaaaaattcaaaaaaggggaaaacagcttataccgtttgcgcacaatgataaatgcaatgccaacacccaccacaatatttaaaacagtggccagaccgcacatgaaaaaggtcattaaaatcgggcggtagtaatgggaaaacaggttataatagttttccagtgtaagcctgattatgggcagtccgtttgctgcaaaatcgataatcggctttccgttcttaaaccggaacagagaatacaccagcagtgttatgtggggcataaatgaaattataacgtaaagaaatataacaacggttattgcaaaaccaagcagcctgcccggtgttttttccgcataccgttttgctgaaatagaggaatacgcctttccggccagtataatccgctgcaatgtcagaaatgcacctgcaataaacaacataatgataccggctgtagctgcctttgataagttgcctcccatctcacttacaaattcattgtaaatgacgaccggcataaccggaaactcaccgcccagcatataaggcgcaccaaagtcggagaaagctccaaggcctgccatcagcagtcctgtcagaattcccggcagagccaggggcaattcaattttaaacaacgtattgattttattgccgcccaggcttaaagaagcttccttatgagcaggatcctgagcgataaaagcttcatagcaggtaagaaacaccagggcggaaaggggccagatatttacccatacaattccgggaatcccctttaggctgaaaggtacgtcaataccagttgccagttggatcagccagttaaaaaatccaaatcgtttcagtaaaatcacccaggcctgtgcccccaaaaagggaggggcacaggaagccatggtaattaatgtaataatcaggtttttattcctgattttataccgcgccataaagtacgcgatgggaacgccaatcagagctgtgacaggggtaataattgcagtcagtatcaaactgtttttaaaagcgctcttcgtggttcgctgggtaaaaaatttaataaagtttatgagagatacaccgccctctttgggcatcacagcggaagcaaagatccaaaacatgggaataataattgcaacgatgctgagaataacaaaaagggaagtcaggtatatccaagggtctttcaaacgtttcatacaacctgtcacctcttactttttattctctggcagcatccagcgtcttggcaaagttatccagtacttcatccttggaattaaattttgattcaatcagcttataagagcttaaatcacttaaaccttccggcggtgccatgtcagtacgggctgaacgtctttttacaacatcctgtaaaactttatgtacatccctgcttaaaataaagtccagaaacagcttggcattatccatgtttttggcgccattgatgatcccggttgcttccacgttatatgtaaccccatcttccggataaatgttcttaacaggctcgccgctcatttcccatttataacctaagtcctcattaataaagcccaccggatttgtcgcatcttttacagcagcaaacatggcatccgagcttggatacacctcagtgtttaaaagcagctgctgcatataatcccaatcatataaagaggccatgccctttacaagggacaagccggtccctgacttggaagggtctgccaaggcgattttatcctttttccactttggatctgttaattcctttaaggtctttggatagtctgcctctgattttaaaagctttgtatttaccaaaatggtttgaggcatgattacgtaggaatgccatttgtggtccgggtcctgggtgatcatagccgcatcttctttggagtcataggtttcgaacagatccggattggacagatacaaaaatgtatcaccgccccaaagcacatcgccgccgggattatccttttccgcgctgatcctggccagtaattcaccggttccgccctttacctcctcaatatcaatgtcaggatatttttctttccacaacgcgtaaataggttcggtaatctccggaccgctgccggtgtaaataacaactttaccggatggacctgctgccgtttccggtgcctttgatgtgtccgctgcggttgtttgagcggctgcagctgctgttgcagccgctgtggtggtagctgactgacttaaactgcaccctgttaaagcggaagcccccatgacagctgccattgcataaccccaaattcttttcatgataattcctcctttttaatgattccattctcctaaataagttttgtgtgcgtttaatatatcttccaccagcacttttgccagtggataatcgccgattaaaggatgtgccattaaggcggcctgggcagtttgaacggactttgtgttaattgcttccacagtcagattctcatatgcctttacactctgaataatggcctgggctgccggagaaagttcccctctttcctccaccaggatgccgtcttttgtaattctgcaggtgatttccataacatctcccggattcatgccaaagtgccccactgaatccggaatggataaaaccatttcccgctcttctcctgtagccatggtcaaaagataattcatcatgacccccgcataaccttccgcattgggtatctgcccgtcaaaaggcttatgagccaatgcctgtttggtttcattaaccatgtaggtagactccctgttgtacataaaccgtaaataagtctgcagcatttcctcgatctgtgtctccgggtccatttgtgaaagagctttaaacatttcaaggttgttttccattacagcccgtccccgtggcttttggctgccctgaacattttggtttgccttgttccggtaaaagaaatagtataaatattcattgggcagatgccccatggtacggatcacatccggctcaaacatggaaaactcttttactttccctaaaaattcatcattctttaataactccggcagtaattctttcccgttatgtaaaacacttgttacaaaggacagatggttcagtcctgcaaactgtacccttagttcgccggcaggaatccccagagcttccgccatgttgatctttgtgccgctgggagcatcacagatacccagcaccctgtcatacccggcattccgaagggcctgggttaccaggccggagggattggtgaagttaaatatccacgcctttggtgcaagttcctttataatccggcaatattctttcattaccgggatggtcctgagagccatggaaaacccgccgactccggtggtttcctgaccaagcacaccatgtttcatggcaatgtcttcgtcggtcacacggccttcgtcatatcccacccggattgtggtaactacataatccgctcccgtaacagcttcacgtatatccaaagaggtgctgactatcagtgacggatttgctttctgcgccgcatatttggataatgcccccataatagccagctttttttcgtccgtatcaaaaagaaccagctgggtaatgcccataagatccgctttttgggccacgccattggtaaaaaatacagttcttacacctgctccgcccagaattactaatttcattttaactcctcctttatttgttttagatttggaactgttttatatccgccatatccctgtactgaggaggcaccgcaaaagttagccgccttcaaacatttttcaggggataatccgtttaagaatccatataaatacccggcattgaatgaatctccggcgccggtggtatcaagtggagttacgggataagcgttactatgaatgacctcaccgcctgtcaacagcctggatccgctggccccatttttacggcagcatgggagcagtaaccggtcagtttttcaatcccggcatcgaagctttttgtacgggtgtattccattaattccttatcattgataaagaaaacgtcaagtttctttgttatttcgaataagcattgatcccaatcccctgtatcgtcccagcctacatccatggaaacggtaactccggctcgatgggcagcttcaataaagtccaggtattcctccagatctgtgcgccccctgtaattagtcagatgtgtatgccgtgctttttccagcaggaccttgggaatatcctttggtgaaacctcatttacacagccgtcgtatgtgataaaccgtctgtccttgtctacatccagggcgattgaaataccggtacttttttcagaaggtatggtttcaatttgtaccccgtatttttccatttcccgtaagatgaattcaccaaataaatcattatgtaccgcaccatagatcatggtcttcatttccagcctgctgagtccaatggctgtaattgccacaccgccgccgcactgcacatacatattgtccacccgtatttcctctcccgggcccggcagctcgtcgtatggcggtacaatcagatcaatattaggcgtacctgctatgaggacatctatttctttcatggttttttgctcccttgtaacggtatatttccatgtgtaaagctttacacatgaagcaaaaatttctccctttaaggaaaaatttttatgcaactgtccctctcaataattttatggggaagtaccaggcttgaatattgccgttcatccttttcgattaagtcaatcagcgtgtttaccgaaaaatatccgatttcttctataggctgatgaacggtagaaatggccggacgcatgctggctgaaatttcactgttatcaaaacccagtatggaaaaatcctccggaatacggtatccgaaatcaaacgcacagttcatgatacctactgccacatcatcacttcctgcaaatatggcggtaggcaaatcatccttacaggttttaatcaggtttttcatcattttataaccatgctctatctttaaaccggaaagccagacatattgctctttcatagggcagcctttatcagccagtgagtcccttaccccttcatatcgctggcggcctacggtaaaatcgtgaagctctgcgcctaaataagctatttttctatgccccagcctatatagataagaaatggcatcgtacgctgccttataatcatcaatattaacactggcacatggaattccattgatatggcagctgcaggcgatcatgggaatatcggacatggcggccagctggcccagcaattcctcatccgtctgttcattggtcaggatgattccgtccacgcacatgcgtttaaatacgcttaaatactttttttctttttctaaatcctcttcaatattgcaaatcataatgctataatctttttcggaggcacagttttcaatgctttttaatatttttgaaaaaaagctggtgccaatatcagaaaccacaacgccgatgatattggttttttgcttcagtaaacttttagccaggtaattaggctcatagtttaaccgttttgcagcttccaccactttcttataagcactttcacttacataaccttcgttgtttaacgctcttgatacggttgcaatggatactcccgcctcttttgccacttctttgataccaatgcccattcttttatctcctgcctttccccgaatgaaagcaagggggagattttctgtgtaaaagttttgtgtaaacctttacatatgtgttttttaaaaaatgccaggtaatttagcacaatgaaattatatcattcatatgtttttttgtcaataatctaaattctatgacatttattctgtttccagctttttacccatattctgttttccccttcttaatattatttataaatttatcatgccataattggacatatattacaaataacggaatttattgtattgatttttatatatagttgactaagtaacaactttgctgatataattaagttgttgctttaaaaaatatatatgtaacttttattgttaaggattcacagaaatgatttacccaatctggcatgataaattcatcatcacatcttaaatttgtaaatattgataattgttcattttccggcaggcgaaggcacggtcaggctgattggcccataaagctgcggacttaccggaacattttaaaagatgtttgcccaatcatcccatataagattttataataaagtttaaacaaaccgctgtttgtttcgttaatagaaagaagctttcgtttttcattgtaaaaataaccgctggaagtttgtttttcacggaatgaataaaatatgtaaggagaaatcaaatggaaaaaaacaaaaaacgacaggtatcaattgaaagggcagaggaattaaaaggaaggatcgaagattttttagaggcccggaaggggattccaaagggaatggatatggaagaaaagttcgttaaaaggaaagccaaaatattagagatattggatgccacggaagaaaactggaataattatcagtggcagcttgcccatagaataacggatattgaaaccattagcaagatcattaacataagtgaagaagaaaaagtgcgcattaaagaagttgagaaaaaattcagatgggctgtatctccgtattatttaagtttagctgacccggatgacagatatgaccctatacggttattatcaattccaacctatagtgaattggatgattcctacaccgaccttgatcccatgggcgaagaatatacaaatccggcaggcagtatcacgagacgttatccggaccggttaattattaatgtgaccaatgagtgtgccatgtactgcagacattgccagagaagaaggaatattggagagaaagatgtccatgggtcccgtaaaatgattcaggaatccattgattatataagagaaaatgaagaaatcagagatgtgctgatcaccggaggggatgcgctttgtctttctgatgagtaccttgagtggatgataaagcagctgaaagagatttcccatgttgattatatccgcctgggtaccaggtgcctggtgaccatgcctcaaaggatcacggatcaattatgctccatgttaaaaaaatatcatccgatctatattaatactcatttcaatcatcccatagagattaccgaggcatcaaaagcggcatgtgaaaaactggctgactccggaatcgttctgggaaatcaggctgtattgttaaatggaatcaacaatgataagtacatcatgcgagtgctcaatcatgaactgctcaaatgcagggtaaggccttactacatctttcatgcaaagcatgttcagggaaccgctcattttaatacatccattgaagacggcatagagatcatggaatacttacggggctatacttcgggcatggcaattcccacgtttatagtaaatgctcccatgggacaaggaaaaacgccgatctttcccaattacattgtttcccgggggccaggctatgttcagctgagaacctgggaaggaaatatcgttaaatatgaagaccatgaaacaaagaatatccgggattaccttgaattttaatgcccggccaaagctgcggcataggtctttatggatttgctgtcacttaagaattttactgatttatatcacaattcctcactgacggcaggacaagacatagggatgaggcaatcagtaccagcgccccagcaatcagaaaccacttttcaaccccgtatttctctgcaaaaactccggaaacggaaaggcctattggaccgcttattaaccggatgctggcagaaagggacatgatccggcctaaatacttcgcttcaaagttactttgcagcaatggggtatacattccccaataaaacggaccggatattcccattaaaaaggagcagacagcaaagacaaaaaagtcttccggcagtaaaaatccggacacaaacaaactaaaactcatgagcagaaaagaaccaataatcgtataaattctatttttagttccgccccatctgcctaagatcaaagagccgataagcagaccaacagaaaatacaatttcaactacacttgcatttgtactggttccattaaagtaagacatactcattagcggaaacaatgcactggccggcatcaacgccaaagtataaagcgtacttatcaacactaagcccagcattccttttcttgtataaagtatttgtaagccttcttttgcttcacttaaaatatgtattttttctgcattttcattgtgatttaatttggggatttctgatattaccaaggtgaatactgcaatcaatgctccaatgacatcaaggaaaatggtaccgcttaagctccatgactgatagagaactgccgctaaggccggaccagataattgagaaacagattccagagcctgagagtatccggaacaccttgtaagttggtcctccggaacaatctgtggagttgctgcctgaagacaaggagtgtgaaaggcagaaccgatggagcgaatcagtaaaacgaataaaataagttctgttgacaaaccccccgtctgctccgcaacgatcatggcaaaaccggctgaagcaatgagcaggtcagacgcaatcataataatctttctattatagcggtcaataaatacacctatgaaagggcctaaaactccctgcggcaggaaccctgccatcattgcagcggataaaatcaaagcagaaccggtcttatcagtcaaataccatacaatcgcgaattggagaacagagcttgaaaattgagaaatggcctggccggaccatatcgtataaaaatttcgcttccagtttgctatggatgaattcatgatttttctctccctaatttggttactaaatagctattataattttcaaatcgataaatgtcaatatattatgctgctgaatcgtcttgcagccccttaaacttattttccattaaaaaatgagatcaaggctacctgcaatttcgctgccttgatctcatttttatataattatagaatcggacacagcaccctatactcctggaccgatctcacctccagctcccggaccagactgctcttccgcactttctccgggttcttctcttgtttttatttccttttctgtttccttttctgtttttttctccggtttcttctcttcctttgtttcctttatattggctccaggtccgatcaggcttccgtcatcgtttgttgggacttccgtttcctcctgctccgttgtttccggaattgtttcttttgtactttcttctgtggtctctttcacactttcttctgtggcagcctctgtttgtgcaggtgcagtctcctttggagcagaagaatcaccttttttcttgccgcctgaatttccgccggatggagcattctttccaggttctgtgatgccgctttcctgagagattttttcgcttatcttttttacagctgaagacggtgaataatcctctttgttatacaggaactgatgaagctggacgacattgctctccaatgtggagggaataacgcaatccatccttccgatcttcatggtggtccgtgaaaatgggaaaccggctgtttctcctatatggtatttgctgatgccctttgctatggacaggacatcgttcataccgatgctggtagatatttgtggaaatacggtagaaaccagggtgctgagggtgccgaaatcagcctttttcgctttctccatggcaaggttcaccaccttacgctgccgctccgtcctgttaaaatccgtatccataaggcggagtctggcataggccacagcttgtaccccatccaaatggttcattccggccttttttaactgataagagccgattcccgtggaattaacagtttcagtaataaaaccgttgatataggcgaattctgaatccgtaatttccaagtcgactccgccaagaatattaatggcatcggcaacggctttccagttaaatgtggcataatcgtctatgttaagatccagattttcatttagcgcatcaactgcctgtttatggccgcctttaaaataagcctcattgatcttgtgataggttcctttgctgttgatctttaaatatgtatccctgtaaaccgataccagttttatttcgcccgtagctttatcaatgttacagatcatttccacatcagataaggcgcccttttccagagttccgtctctggaatccacaccgaaaacggcaatggtccaaaatcctttctgatgggtgcgctggcgaaacaggaaaaatccggcaagcagtaccagagccagaactgcaagctccaccagtattactctctgcttatgtttacgcttccgctttttatccgccttatgtttggcatttttttgcggcccgttatagcggacacgtgggtttcttccatcacctgtactataataggtcctgtccccttttaccgtatgcggctgatgctttctttccccggactgcgctctgtctgcacttccgttttttttgctgccctcccgctttttgcgggcccgcatgcggtctaattcatcctcataatccatgaccgaatattcaatcctttccaatattttctttggcagatcctatctattctatcagaaaccagactgaaatttcttgcttttctcttaattttatcagtcaatcagctttctgcagtacggccagtttgcatccatggttgaaatcgtaacattattaaccaatgcgctggactcgtggatcactgtcatatttccgttgctttcccagcagaaaaacatgaccacatgggcgtcgtctcctgtctttaaaatgatatcgcctggctgtaagtcatttctctgagtgggggttccgcaggaagccaggcctcctgtgctctcacaggacaaacgcttgttaagagcggaccagtatacccagctgatccagccggaacagtccagccctttcatagaacggcctttttcatccggtgatatcagggagccgaaagagtttttatcatagcctgcagatgacggttttccgccccagtaataaggaactcttcccacggaagacaatgcataacggatcagttttttccggtcttctgaaagattctcaggaaggcggctcatgtaactgtcaatttcctcataggaaagaggatttgtaataaatgaaggggaaagagtgaaaccatagcgttctgtccagtcctgttttgcaagttcaaaagtacaggctttgttttcctccgtccatcccttccagctgctcccttccgttgtttcattcccaagggaatcaagggaaaataatcctttcttggaatcggaaagccctgcaatcaccgctttaacatgaagatccacatgtccgggacaggtggaaggcaagggcgcttctgtctctgcgggagtttccccttcagcttctgcagccgcagcggcagcttccctaagtgcgatgccagggccgatttcctttgcaggttctgttcctttggcctcttgagtatcactggaagcatctgaactgtctgaggcggtctccggtacggcagaggattggggaatctcttccatatctgcctgggcaggcgtggctgtttgctctgattggactgcagcaggcttttcctccagggaaccgccgcaatcataaatatcgctgatggaatattggaagctgtgagagctttcccacagcttaagggcataatctaaaaaagcatcataatcctccggtgctgtataataaaaatatgtattggccattgccataatttcctgaatattggactgaggagaaatggatcttccgttttcatcgtaaaaggtgatatggattttgttaaaagaaagcccctttaattggcctgcggtcattcccaggcttaaagcaacctgctcagggctttcattggccagttggtaaatggaagccagccaatccgattccctgcgggaaagggcttctgccgcttctgttcccaggcttttttcctggctgtctccttctccataaagaaatgcaagattaaatgcatcaagagaagggacaaaaggagcaggtgcttctgctgctgttgccgtttctgctggagtttccattaattcggcttttaccggaaggatggtttctgctgcaggtatgatcttcagtttatcgtaaggtgaagggtaagattgggaatatgtgcaaaggcacactcccgtaagagccataaacatggcggctaaaatctgtactctgaccggttttttcaaattcatctgctatcgttcccgtaatatttttatagaatagaactatagcataatcagcggccaaaatacagagagaaagatttaatagtttattaagattggtgaaagaatcaatagacagcggctgcttcagagaggatcagggcgtctattgcaacagcaactccatcttcgtcgttgcttctggttatgagacgtgctttgcgtttaatcagttccgtagcattgcccatggcaatggtatatcctaagggaaggttcagcatggaaagatcgttttcactgtcccccattgcaaggatttccctggggcggacttcagtgtttgccgcatattccataagggcggaccccttctgcgcccttatatgggtcagttccaaattggagggagcggatgaagcaacggagatcccttcctccatttccagggaaaagcgaatctgttttaagacttccggatcttcatggacaacagacattttataaatatcccaggaagaacccagaatcacttcttctgtggtgaaatgaaaccgctgtacaattgattcatacgtatgctcatcagaaaccattggaagaaaaatcttatcctcaaagcttttacggaattcttccatggtggaggtggtgcagcttccctcttctgtcataaaatcataaagaaccgaaaatggacggcaaatgctgagtatgcggttaacctgtttttttaacagaggctgtttccgcatctgcctccctctgctgtcaaaaacggcggcgccgttcatgcagatgatatcgcaggaaattccggcttcttttaagggcagggaagcgtctgcaaagcttctgcctgtgcagactacaaaattgatatttttccgcctgagagcttcaatggcggcaatgtttaaggaggatatctttccaaatcggtttaaaagagttccatccatgtcagatgctactaatcgtatcatgtaattttcctttcttatctacaatttcttttgcaatgtcaggataatcggtaattatgacttcgatctcctgatctgcaaggtattccatcatgtctttgtcatttacggtccatacgtgaaggggaagcttctttttcttcgctttcctgaccagcttcttggaccggaggtggtttaaggacggatgaagtgcgtctgcccctattaattttgcataagccggtacattgataaaaccgtccgagaaaagtagacctgtcagagccttgtgatctaatttcttcacctttatgatgctggggtgatggaaggaggaatagatgacccgctcctccattccggctttttttacctgctttaatgcttctttctcaattcccttgtaacggaaaactcctgttttcagttcaatattgacagtgagaccggaaggttttacaagcgccaatacctctctcagctccggaatggctgagctgttaaattccggccagagcctgccgcagcgaaaggctttcagctcttccatggtgaaatcctttacataaccgcttccatcccagaggcggtcaatggtttcatcgtgtattacggccagttttccatcctttgtcatctgtatatccagttcaattccatcggctttctgcctgatggccagttcaaaagcctccagcgtattttccggcgcataagcagaagcgcctctgtgagcccaaacctttgttctcatctgtcaatatcctttctaaattgctatttagttgttaataagattatagtcttcaatggacttattaatgctatctgccatctttgcaactgcatcttccggggtgcctttgttgttgatcatgttttcgatctctgtttccacgatctgccttgcttcagggaatatgctgagaagcgctcctgcggactgaggtgtggaatcatgaagctggtcaatggctgttttaaactgggggtattttgcaatgttatccttgaatacagcttcatcgtgagcggcaaccgtaacaggaaaataaccggtctgggaattccagtaggcctggctttccggggaaacaaggaattttacaaattcccatacagcctgctgtttttcttggtcctcattattcaatgcccataaggaacctccgccaatggaaacacctcctttatcgtcgtcactcacttttggaaaatatgcggtccccacttcaaatttgccgtttacatcatttaatatctgctttagtgaggcggtggatcccagagtcatggctgccttgcctgcactgaaatcggcaagtcccgcatctccgccccgtcccacattgggagcataccctttgtctgataagtccttccacgctgtcagggtcttggcaccggctccgtttttatcaaaatccacagccgttgccgctgcctctcttccgtttccgttatcagcgtactgtgcctgctgcttgcaggtaaactgttcaaagaaccagccgtatatgcctaatgagatcacctctcctgctccgcccttgttgatgagatcatcaccgatcttttcaatgcccggaaggctgtcagggatttccgtaatgcctgccttattaaaaatatccttgttataataaaggatgggcgttgaagagttaaaaggcatggaatacaaggtgccgcttactgtgtaataggcagcaatgtttggctcaacctggcttaaatcccattgatccgcatcgatcagctcctgcatgggaatgacccagccggaatcgatcataaagcgggtgccaatgtcgtaaatctgtaccagatcagcgcccatgctgccaatctgagcacttttcagcttgttgatggcatcgtcatagcttccctggtactgggcctctacggtaatgccggaagtgttttctttattgaaattatttacaagtgtatcaatggcttccccgtttacgccgcccatggaatgccagaaggttatggtggtgcctttcggactgacggtggtttccgctgtctgggctgcagttgtctggggttgtgcttcggacgaaccgccgctgctggtttctgttcctgtctgactggcgcaaccggacagcgctcccgctgccatcatgaccgccatactcatggcaagtactcttttcttcatcttctttcctccaaaatttattttttctttatgaaatccgattcgcctgttggctcatcgaacggctgactttctaagcttaagcgcactttactttcttccgccgagaaaatcatgcctctgaaccaggtcagcctttgactgcacctgagaacattcccctgatcaattgcctctgccctgcaatgaaaacagagatggatggaatgatgatcatgacaacccctgcgatcatcatggatatggactgagagtccacgctgtctaacatgccgatcccgatctgaaccgttctcatgcggtcagagccggtgaccagcaagggccacatgtacatgttccaggcattgataaaggtatagacggccatggccccgatggctgatttggtaagcgggatcaggatgctgtaaatgaatcttaagttggagcagccgtcaatccttgccgattcaaatagggaaatgggaaaggatttataaaactgacggaaaaggaaaattcccatagctgaggtgagataagggataatcaacaccttatagctgtcaagccattttaatccgcttacggttaagtaatttgagatgatggtggcctctcccgggatcatcatggtggccatgacaatcataaacagaaggttttttcccttaaaatccagaaatgagaaagaaaatgcagccagggaacaggacaggatctgcccgaaggtaatgcagcctgccacaaaaaaggaattgacgataaaccggtttaaggggattttaaccattgcctgacggaaattctcaagggttgaatgatcggggattaagttcatctctgttgtgaacagctcgctggagggcatgagtgcaatgctgaccgcatacaaaagcggaagcagaataaaaacggatacagccaggtttacgatcaccaaagccagctttcccgctctcctgcggaaaatggctttctggctggcggaccgcttcagtttttccagctcatcccggtccatatctttgactgctgcagtaatgacggattccatcaatagcttacccccttcttttccagatggaacatacataaggtgagaatcattattatgacgaacaacaacacggactgggcggctgcgctgccaaaacggtagttgaaaaaggcatcccggtaaatcgaataaacgatcaagtttgtagattctccaggtccgccctgagtcagaaccttaacctgtccaaaggactggaatgcctgaatgatattgactaccagggtgtaaaacatgatagggcttaagcctggaagagtcaggcggaaaaatttctgaaggccatttgccccatccacagaagccctttcataaatggtctcatcaatgttgcttaacccggcgctgaaataaagaaagttgattccgctgttcagccaggcagtcagaagggccacacaggccagggcatacttgggatcgctgatccagtttatatgaaatcccagaagcttatttacgataccaatggaagggtgaagcataattttaaatatcatggctgcagagctggaagcaattgccattggaagggcgtaagcggtgctgaatatccggatccctggaaaggttttgctgcaaagaactgcggcaatgagccctaaaagcatgctcaccgacacaacgataagaacaaaaattgccgtaaccagaaggctgttgaaaaaagaccgggaatttaaaaggtccttgtagtttaacaaaccgacaaaaagcttagcctgccccattttattggtcttgtagagacttaaatatatagtcttgaaaaacgggaaaaacaggaatactgcaaatattatcatagccgggaccatataaacataaggccctgctttcttcacaattgtttttatgttcataagaaaactcctaaacgtataaaatattttgttctgtatccatatcgaagagcctgatccggtccatatccgcgtaaacaggcaaactcccgcctggttctgccttaacattgggggttaaccgtgtacatacctctgcccttccgatcctgccataaaaaagcacttcagcaccaagaacctctttcatttccacgtttaaaagaagcttctcttcttccggtccggattcatggaaatcctctggccggatccctaagtagacacgccttcccacatagccgccttccaccagccgttttgcacagtttccattgacaaagagcctgtttttactgaattccaggcagatcctccctctcgacccgctacccagaccggcatgaagttcatggatggggaaccgataaagcctgccacaaatttattgacgggattctggtaaaggtcatttggagatgctgcctgctggatcactccgctgttcatgactacgatcctggtgccaagagtcattgcctctacctggtcatgggtgacgtaaatgatggtcgcccccagttccctgtgtattttggcaagctccacccgcatctgagcccgcagctttgcgtctaagttggataagggttcatccatcaaataggcttttggctggcggacaatcacgcttccaatggcaacccgctgcttctgccctcctgaaagggcagaaggcttccggtcaagcaaatggctgatatgaaggatttctgccgcacggctgactcttttatctatttcttcctttggaaccttgtgaacctgtaatccaaaggccatgttctggtaaactgacaagtgggggtaaagggcatatgactggaataccatggataaatccctgctttgagggcttgtcatattcataagctgaccgtctatccataattccccggaagaaatatcttcaagccctgctatcatacgcagcgttgtggactttccgcagccggatgggcctaccaggatcaaaaattcccggtctttgatatcaagattaaaatcctttacaacggtctggccatttttataggttttacatacatttacaaaagacaaacttgccatcaacttttgttcctttctgcatatcttaatctcattttatagaagccatgtaaaatgaaaaaggaacttttcgtaaaatgaatgtaaatcatggtattgacgcacaaacgatcacaggatataataaactagatttatgaaggaggcataaatatcaatagcaaagctaagcgccatgcacctgttgatacgatcgtgaacatttttctaggaaaaatggtatcaaaggttgacgaggtgaagggttatcgaattttcggcggatgcccttccatgcccctccgggcgtgtatcttacgtgaaatatgcgggtaactgcaaaacaaacacgttggaaccggagatataattggatgtgataatggacaaaagctgccgttttttaaaattgaggccagacagcttactttttgtctgccattttttaaggacaagagcaaaactaaaacgaatatataaggagattacgaaattatgtgtggaattataggatataccggacctttagactctaaaaagatattgattgatggattgtcccagctggaataccggggttacgacagcgcaggcgttgccctttttatggagaattcccatatacgcctggtcagacatacaggaaaagtatctaatttaaaggaagaatgtaaaaaaatcacaacagtgtcccattgcgggcttgggcacaccagatgggcaacacacggaggtgtgacaacccagaatactcatccccatcaggccggacgggtcaccctggttcataacggcattatagaaaattatcaccagctgacccttgactttcatctgcaaggaaaacttcgttccgaaaccgacagcgaagtggctgcctgggttttggaaagcatttaccagggagatcctgtggaagccatttcaaaatttgtttcttatttaaagggttcttacagcttttgtgtgatgtttgaggatcatcccggtgagatttatgccatccgaaacgtcagcccgctggtagtagcctatacccggtccggttcttttgtcgcatcggatctaactgctctcattccttataccaggcagtattttgtggttccagaagatcatattgtgaagcttacctcctacaaggtccacctttacaacttaaaacggcaggaagaagttcctgagatcatggaggtaaactggaacatggatgccgccatgaagaacggattccctcatttcatgctgaaagagatccacgaacagccggaggctcttaaaaacaccatattgccccgtctggttaaagggcttccggattttggcgatgacggcattccggattccgtgttagaacagtgcagccaggttcacatcgtggcatgcggaactgccatgcatgcagggatggtggccagggctcttatggaaccgttactgaggattcctgttacagtttccattgcttccgagttccgttatgaggaaccccttattgatgacaaaaccctggtaatcatcatatcccagtcaggggaaaccatcgacaccctggctgccttgcggcttgcaaaagccttcggcgctgccactctttctgttgtcaatgtaaaaggctccaccattgccagggaaagcgactatgtcctttacacccatgcaggaccggaaattgcagttgccagcactaaggcatattctgtacagctggctgccctttacatggtatgctgccggatggcctttgtccgagggaaatatagccatgaagaagccgaggattttataaaaaagctccttgatgccataccggccatggaggccatgattgaaaaaagagatgaagtaaaggctttggtgacccacttgatcaatgagccggatgcctttttcatcgggcggggactggattacgcattttctctggaaggtgccttgaagttaaaggagatttcctatattcatgcggaagcctatgccgccggggaattaaaacacggaaccattgctcttattacggatcaggttcctgttattgccattgcaacccaggaaaagattttttcaaaaaccatttccaacatccgggaagtaaaggcaagaggcgcatttgtgattttgctgacaaaggaacgatcaaaggttgagcctgggatcgctgatgctcagatcaatattccggaaataggcgacaggtttacggtattccccatagtggttgtcctgcagcttattgcatattatgcttctgtgggaaagaacttagatgtggatcagcccaggaatctggctaagtctgtgactgttgagtaatttcgccgggaaagaaaaaaacaggaaggaaacggcaaaggctgtttccctcctgtttttatcttatagaaaagttctctgaactttcctgtccgccgcagacgcaagggtctgcgatgcaaatctggattctataagctttagtttcaaaacttcactcttttaataatgataaaaaggatttgccgttttccggaggatttgtgttaaaataatcacaaacagttgcaccaatgtctgacaaggtttttctccttcccagacttcttcctgtaataccttttttataaaccagaagggggacacgttccctggtgtgcttgctgtgaccgatattggggtcatttccgtgatcagccatgattaccagaatgtcctgggaagacagcacaggtaagagtctggtgattccctgatctgcgatttccagaatctttttgtaagtcgtagtggactgggaatgtccggccaggtctgtctcctgcacattggtacataaaaatccatgattcaaggcttttgtttcccgaagcgttaaatccatcacttcctgagtcggtacgcaggaaatactcaaacctccatcgtttaatacaatatccgctacttttccaatcagagtgcagtcaaaacctgcttttgtcagaatcgtaggtgcctgtaccttctgatccactccataccccaaatgcctgcactggtagccttgttcgtaggatttggattttgcagatgcaatgccgatgaaacggccctgctttacttcctcagcattccaaaggtcttccatggtatttccggttccgccaaagacgatcacccggcctacggttaccacttcccttacctttctggctatggcatattcctcttcaaaggagatcagatccaggggcgccgttacgttataacacatccctaagtcagcttccagattatcggctacagtcacgcagtgatctaccagcagatagcgcagtccctgccgttctatgaattgtacctgatgtccatttgcctccagatgtgcttttacttcttctgctttttcctgaaagggatggacttccggttttttgggaagggttcccataatttcctgatggcccataaatgtgtctgccccaaaatgcatgagttcgcagcttccgaagttagcctcaggtgagaatttcataaaggcactctcctccccataggcattcataagtcccagcctttccagtgccggaagctttaaatcagggtggtcccttaaaatgctcctaagggtattggctttttcatcctccggcctggacagccttgcatcctccatggctccgataccgaatccatctaaaacaatgacaatcaatctttttttcaaaatttgcctcctaagtgaatgaaacaggtatgaaaatttatgtttcaatctttctccccatgctgtcatatattccaacgattctgggttttttctttttcagcccttccaccagcaccacatctgaccgggtaacaaagatctggtaacggaaagccataatgaccgtattacctacatttccttcttttgtcaggccaaaatgataatcaatgctgtcatcggaagggggaatcactcccattgccgtggaattttccagaccagtcccaaccagggctgattttacatgggaccgcctgtaatggccgccgccgtaacaataagcctgcccattaaaattgtgggatatttcacttacataagtgacacagggaacttccgccagcatatggtccgcatgcatgggagtggttcctgtcaggccatggcccggctcggcgcagttacctcccagctccctgatcttattaagcgtgtaggtacaggaagcggaaggcgtattgataatggataaatgcaatccctgctcctttaaaagccctgccgcctgattcacagtctccatatttttggtggggattaagtcatgggaagtttcatcatataagaaacagggaaaagacgtaacacctgcgatccttacacaaggatacctggttttgacacgctctgccagatcttttaattcttcaaggtggaaccctgctgtctgtccagagtagatcgtatcctgatcgccataaacacgaagaacgatctcctgcaaaagtcccagtttctttgccgcctcatggatctggctgatcttttcctcggaataaactgtgatcatccgtggtctgtatgccaccaacgcctctatctgagcggtaggaatctgcaccagatgtccggcatttgcgattgggatccggtgatccatcatcactctggcttccttataatccaccacaacggcaccttcgtaacccagctctaccagttttcttgccagataggcatttcttccagcctgcttcagcataaaaaacagccggatctccttttcctttgcctcttttaacataaaagaggcattttccagaaaggtatctacgtctatcacataagagtccggctggatctggccgttttgatgaaggtcaaaagccactttgatcagttccgggtttcgttttatggtctgttctaaaaacatttatatcactctttctattgcttcatttataatgcgtaaaatggtatccgtcccggaacgcatgggatttatgcggatcatgcgtttttccagtgctggatccgcattgcggaaagtacctgatatcctgtaaaacataggaaccagctcatattttgattccgcaccaaccggattcggcgctgcccccagcttttcggcttcaataagaaccttttcagcaatgttctcataaaactccaccaacagtacctttgactgggcattggcaagaaatgcctgttttacatgaggaatttcacctgcattcaaacgctttacacattcttcatttacctgggcctggatggccagggacacaggcgcataaacaaggccatggagtacatccagggcttcatggccctgaacctgcatgcctccggaatagctttctttcacaagcttttcaatataacatgccttccccacaataacgcctacgccctccggccccaacagcttaaatgaggaaaagcaggaaaggtcagctccacactggatgccgatccgttttactttcatggcagcgtagttgtcatcagtcaatatgggaatatcgctgcactccttaatggtctttaccacctgggtcagatcgtagcggtcatccggcttttgccgggtgtattggatgagggcgccttttatatcattgttttctttcatcacccgccgtatatcacccggatcattgaaatcagcctctatggccggaatattcagcatttccaaagatgtggcggtggtgttgtaaacaggtgccttatgcaccaggatcttttcgcacggatttaacatgctgtgaagcccaaaccggatggcaccgcttccggctcctctcaccaggatacaagcctctccatcaaataaatctgcaatcaccctctccgccttttttgtggtgattggcttattaagtcccggaacaacacctaaatctccccggtttaaaatttcacggccgctgaattcttttgtgatacaatcaatcacttgaaactgcagcctggcagcctcctccacggagatgctggataagggataagtctccatatttcctgcctccttatttcagaatccggtccggattgtcaatgagcagcatatcaatttgttcttcagataacccatattctaaaagctgcggaagaaaggtttcaaacagataggcgtaacccagacctccccatttttttagatgggattttcttgtaatatccatagacaataccacctgtcccagaaatccttcttttgcgatccgctttaatgtttctgcacgaaaccggtcaggacagtaattgttttttcccacagtatcaaatccaatgttaacgccttccttcagtaccgaaagaatgtaatctgagtcctgggaaaggtctaaatgaccgatgatgattttttccggctttacccctgctttttttaggtattccgcctgctccaaagccagggttcccagagtggtatgggtggtgaccactgcaccggtacgtaccgccgcaagagccatggaatgaaacacttttttttccatttccgtcatggttcctttgctggttccaaattctcctatgacacttgccttgattccagaagcttcaatttcctccgtcacttccttttccaccagttttgccagctccatttcagacatggaatacacaaaatccggaagaaaaggctctttataaaagccggtggactgcaaaatacgaatgccggtggctttttccatccgtcttacatattccggattccttcccatacccatgttggtcacatccagaatgcgcctgacaccaagctgatataagccgcaaagctctgcttttgtttcttcaaagcagtccagccggcaatcctggtcctttttgacccctgataggtctatggtaatgtgttcatgcatcagggtataacctttttccatatttctcctcccaatgaatcaagccctgcttttttagaaatacatatcaaaattcataaaataccgctggatcagcagtgatcctttgcaggtcagtgacctggccttttggaacatggctatgatgtcctctggtttgctctcacagatgagaacggtacaacaccctaattcccttgcaggaatggtcagtgctgattttccgcacatgttggcaacccgcatcagtccttttcctgaatgagcctggcattgttctgtttctttatcaaaatggccgtaaatgctgtcacccatggaatttacatctacaggtccttcctttgaaatcaggatggtatttggacttaagattccgtttaagtattcaatcaatggttcccggcggccatagatatccggctggctttcactgggaattactttccattcccagccgtcctctccgtatacggattcctctgccatgtttattccaagcagtggattcaaaacctgttccagggtttgaagatccctggcaatggcaccaatgcttggagaaaacagaattccgtccgtggaagattttgaatacagcctcgtatgctcctgttctattaatggagagatgaagccaaaaagattgagggcagcggcaggtgccagcacactgccgcctccgtctgttccgatcccaacatcattgatcccataaaatacattaagggctgtaccgctgctggagccggtcatccatcttcctgtaatgggattaataagctgtaaatccaccgctcttccgcccaaagccattttatcgtcggtatgcggcagaaatcccttttctttaagactcacttttagtttttcgggaatgaccggggtatccttgattccggtataccatgcaaacccgtgctcctgaagagccggggcaaccagatcaatgaccaggggatagactttgtttacagtacaataaggatttttaagtgccaaaaatgttttttttgcataggtttctattctttccataacgattcccggattatttggggccggaactgcaatgaggccgattatgagaagcaggttcatcaatactccgaagatgatacatgccacagggcccacagccagatctacaatcggctttttcgctttcttatttaacaggaaggctccgattacaaacaatgcccctattccggtgtatccggaagaagcggcagccattttttctgcagcaacaataccgcctgccagcaaacaaatttccagaaccttgttcatggatgttctcacatactctcccatatccttgactcccgggaatttatccatgtattttgcaaaaatattaataaggaagatctcagccaccatgactgcaaatcccagaacaaaagcaatgatcggatttccatggaggaacagtcccactacaaatacaaaggtgcagccggccgcaccgtacacacctgtaacaatggcggtagtaaataccagagggataaaaccaatggctcttgccagtgcggttaatcctgcgttgctgtattcctggctggctaaaagggccagggaagccgggtcgccggcaataatggaaaggctggttcccgctgcaatcagacctcccataatggccagcagcagccagtttttacggatgcgcaaaatatttccctcaaagccctgggtcagccctcattggtatgttccgttcctttctgctgagcggcataaaggatcatcatgatcatacctgccagcattgccataccttctgcatttaaagaaaccttgccggcaccaatggcaaaggtaccgaatttttttacaagaaaatataccaatacggttacagttcctgcagtcattccctttttaaatccatgctgataagcaatgccaactgccggaaacgcggcaaatgcaaccgttacatatcctgaaacgcttcctaagtcactggtaaagttatatggcatatagctgaacaatttcacaacaaactccagacctgccaggatcgccaaaccataagcagctccgatgacagcggaaaggatcatcccgttcctgctgttattacagaaagacccgatgatatcggtagtcagcagcagacaatggatcaggataatgctggctgcaatggatgtgggaataccaaaaccgatgaccaggccgaaactgatggcaaagctcatggcagccagttctttccggctgatttccccgttaaaatactgtcccacaattggccggaatccgtcattaaatactgcgatcccctgattggacagaacggaagccagtgctccgattaatgcaataactatgtatttcatattagttaaacccctctttctcaataatcgccttcagcagaaccggaagtacctcttctttgtgctgagctgtaaacccaaatgccttttttcccttttgtacctcttctctgatataatccccgctctttacatttcctggcatggaaatcgtagaacagagcccggaacccagcatggccatagccatagccagtgctccgccgccgccggtattgcaggcgccaacgtaataatcatacttcccgttttttacgcctagtgccgcatctagatcccctttgatctcgatctctgccctgcctttcatctgcagagccaccagtttggcaatttcttccttgtcaatctgaccaccaaccacaatcttcattgctgctatcctccttttatccttgtatcattttcttataaaggctattcggccctgataccttattatgtgagcagattgcacagatgaacggtcaggaaatcctgctccgcttccgggaaccgaatatccgtttcctttaacagctcatcttttaactctgccgccctttggtaaaccaactcttttttaaccccgtcaagcagtgtgttatccaaggggtgttcctccactccatctaaaaccctttgccctgccatagccagatgagtgatgaacattgccgccttatcctcctctgtgtcaggcttttcttccaggatccgttccactgcccttttggaataatccgcgacttttttgcaaatcacatggttctcctccagaatgtccagacgctggtttaaaatatctcttaaatccattgaatgccctccttgattgaatatacattattttgtactttgcgataaaaagacaccctttaaaaatagggctctcttttttctctcttacttcccggataatatccactacctttggtacgctgacatactttttcagcagggtttttaaatactcatcctcttttctgataaccattacagccgttgaaaacagattgttataatcggagtcatctaaaaatattacgtttaattgttcgtggctgtgctcctggatatcgtcatagttccatacaccggcatctatgattccagccatcaaggagttaacggtctgctgggtccggatgggaaccagggtaacctttttgccatggataatatttctggtaatgcagctttggtcaatggagctgctgtcatatgctaccctcatgccatcctgaatgctgtcatatctgggatctgataaaagaagtacgtgcctggaaagaaagcttccgggaccaaagtttatagccacctcaatctgccttccttcttttatggattgttccgccgcatactgggaacaaaccgcaaaatggtaggtgcccgattctaccagttcaatacgccccaccgcacctctggcataagccatgttaaagttgaggggtgcgaactggaggtacatggccgtagcaaagccctcgtaagtcacagaatagggaaggggcataattccgagaatttccctgcgcatgcagttttcctgcagttttttgtaatcaatctctttgatgcaggttccctgatgtccatgattttccaaaattacagcattacactcctttaaacaggcaaatgcattttgaatagtccccctggatacgccgaacttatcctggtattctgagataggaagaatccggtcccctgcatttctggacatgagatccagtgccaacaaattttttgccacacctattttctgatataggtttcccgattctatacatttgtttttcatgggatcactcacctttatcaatttacattattttgtatattcaaacagtatcataaagcatgtgcaatgtcaacaatatttttttacatatcttaattttttgtacaggaaatacaaatttccatacaaaggtctcatacataaaacggacatttccgttatatcacagaaatgtccgtcttttcccgattcaatgaaaataatatagtgcttttttcttcccataatataggctttatatgataattcattccttacctgtgcgctttattccattccatctttgcatctacaaaattgcggatcagcttcacggtcccatccacaccgatagagctccggttaatacataaatcataacttcttacgtctccccacttcttattggaataataattatagtagctggaacgttttttatccgttttgaccataatgtcttttgcttttgtatcatccacatgatacagctcctttaaggacttgatcttgtcttcttcatcggctgtaataaatacggatacaagattgggatattccgccagagcataatcagcacatcttcccacgattacacaggattcttcatctgcaagctgtttgatggtatcaaactgtgctaaaaagatcttatgattaattggcatatccatgtaaccggaggtagtaaatcccatggaatatgtatccatcaccagggagtacagaaaactgttggttggcttttcatcatgggtctggaataattcttcgcataacccgctgttttttgctgcaagtgccaggagctccttgtcatagcacttaattcccagttcttctgccaatttctgtccgatgacttttccagaacttccgcattgtcttccaattgcaatcactaaatttccactcatatagacagctccttccagttatcttatacttatattatacatcgaagtttctgaaaaatctataattatattttaatttaacagttttttaagaagaaatcttttggttaacctgttaagttgtccgtaatattcttaataattcttcaaaataatcaggaagaggggctgtaaattccatgtattctccggtcctggggtgaataattccaagtatgccggcatgaagggtctgccctgtaaggcggaacgggcacttggcaggtccataaacagaatctcctaaaaggggatgcccaatgcttgccatatgaacacggatctgatgggtacgccccgtttcaagctggcattggatataagtaaactgcttaaaacgttccagaacacggtaatgggtcactgcttctctgccgtttttttcattgatgctcattttttttcggtccaccggatgacggccgatgggggcattgatggtaccctcatcctcctttaagttcccgtggacaatggccgcatattttcttgtaatggaatgttccttcagctgttcagaaatggaattgtgagccatgtcatttttacatacaataagaaccccggtagtatccatatcgatcctatggacgattccagggcgcatcactccgtttattcccgataaatcattgcggcaatgggacatgagtccgttgaccagggttccgctgtaatggcctgcggcgggatggaccaccatcccttgggcttattgattagaatgatatccttatcctcatagatgacatcaagggggatttcctccggcaggatttccggttcttttatttccggaagggacagggagatcaggtcccctgtattcactttataattgctttttaccggtttttccttaaccagcacggattcctcctttaaaagcttttgaaggtaagaacgggatatgtcctggcaccggtcagataaataccggtctatccggacaccggcttcttcctgagcgactacaaactcttgcttcaagtctgctcctcctttttatgaagggaaagacaggataagtcttcctctttgtagtaaaacagaaacaaaagcataaaaaggaacatggaaaccgtaacatagcagtcagcaacattaaaaatagggaaattgatcagcttaaaatacagaaagtccaccacatagcctctgacaaagcggtcgatcatgttcccaacggctcctgccgacaaaaacatggcgattacgtgcagcggcaggtattttctgtcagcaggcatgcggctgacggcaaaggccgctcctgacagcactgccaaggccaccagcaggaaaaacacctgttttccctgaagcattccaaatgctgctccacggttttcagaataaagaagctcaaatacaccatcccatatgactaagggtgtctggttcataagatgctttactgcaagaagttttgtccattggtccaggccgatggaaagaaaaaagccgatgatcattccaatgatcagttttgttttttgattcatgtaaatctccttaagctaagatatggcgaagcccttctgtcatttcagcttcggtgacggtcttgtggacgcaggcttttccgatctgctctaacagaataaaccggatggaaccggaatccatttttttatcgcttcttgtagtgagaacaatattttccggggaaagtccgcccactgtaacaggcatgccaaattcctccattactgttaacagtcttggaagctcttcttcccggatcattcctctttttatggaaattgccatggcagcgatgcagccaaggcctacgcaatggccatgcagcagccggaagtcagaaagcttttctatggcatggccaagggtatgtcccagatttaaaagagcccgttctccctgttcggtggggtctttttctaccacatcacgcttgatccggttgcttgcaagcaccatttcacttaatacagttaaatccctgttccggatcttaagggcgtgttccataagccattcgtaatataatgcgtctttaatcaacccatgcttgacgacctctcccattcctgaagaaaactgttcttctgaaagagtttttaaggatgcaatattggaataaaccagctttggcatgtgaaaggctcctaccatatttttgtaggagtcaaaatcaacgccggttttcccgccgatgctggaatccacctgggacagcagggtggtaggcacctggatgaaggatattccccgcagataggtggctgctccataaccgcataaatcccctacaacgcccccgcctaaggccagcagataatcatggcggtcaaactgctttaaaataagggtttcatataagttcctgactgtatccagatttttgttctcttctccggcagggaaaataaagtgttctgtttttttacagcagtcagaaacaatggtttctacctcctcaaggtagagaggggcaacattggaatccgtgacaatacagaccttgcggtcttccaagtttaactttttcagttcttccttcaacccgttaaacccagtttccatgacaatctcataaattaaggtaccgttcatgtgtaccggaattctatatcccatgatattctcctctttcttgtccatgtttttggacagccaggcatgcccgcaggacgttcctcttttttgtccatgttttatttaacttataagcatgtcccaagggcgttcatccgctgtattattttatatccctatatcatggaagaaagcaaacaatcttccgtcccgctccctccattgcaatgctgcaacgatttgaggaagggggtaatgtggaaaatcgtctgcttgtaccattcaaagaaatgtatgatgtcttttttacagaaatctgttaaaggcgtaaattcatcccgcccatgtccaggcttccattatttaacaggtcctgaaaatcaccggagagctcaacggattccggcgttgctatgaatatgtaatttgatatcttctgcaaattaccattcatggagtaagtggcgcctgaggtaaagtcgatgattctctgggcgacttccgtatgaatgccctccatatttaggacaacagcctttccggccagcatataatcgcaaatttcctttgcatcttcaatggaggtcggttttaccatggatacttccatcgtacggctctgcttcataggcactacctttggagaacgggacagaaaacgaggcttttgctcatactcttcttcatcctcgtagtaatcctcttcactcttttttgaaaaaagggtccttttcgcaggtttatcgttttcatcttcgtaatcatcatctaaatagtaatcgtcatcttctgtatcatttaagcgcatgctatccatcagtttgcctaaaatgctcatacttcattctctccaatcttatgccatggccctaagccggaaaataactttccagtgcccagacatataatctcactaaattcatgtctgatctgcacagcagaatctgctccgcttctctcccactcattaagtgttcatataatacagcttatccgaacttgcaaagcaagtaaggataaaagaggcgttctttgccccgtccatccgattatgggaagtgctttttacttcccataatatcttgtaccgaaaattccggtaccgactcttaccagagtagcaccttcttctatggcgacttcatagtctccggtcatacccattgagagcgtattcatattaacattatcaatgtttttgctttgcatgtcaacataaaattgtcttaattttttaaaaactgggcgattttcttcagaattttctacaaaaggtgcaatagtcataagaccttttatccttacatggggaagcctggcgatttggcgaatggcgctttccgtctcctccagtttaaatccaaatttgctttcctcttctgccacattcacttccagaagaatatccgcaaccaaatcctttctggccgcatcctcttcaatctgctctgccaggcggatggaatccacgctgtggatcagcacggctttatcaatgacttgtttcactttattccgctgcaaatgaccgatcatgtgccaccggatatcctccggaagggcaaggtgtttttcacacagctcctgcactttattttctccaaaatcccggcatccggcagagtaagcctctgataccatggaagccggctttgtcttgcttaccgctattaaggttacttcttccggatttcttccagctctcttacaggcagccaaaatccggctgttcacttcttccagattttcctttaccaaaccaatcacctcttatttatttataaattagttccccttcactgacagactctgcattcaagacgatgtgatcgtatactgccagcccataggtcatgttctttttcactgtgtagtattcatcattggaagccagtacatcaatctgcttaaagacagcataccctttgtttatgttatatactccctgaagggaagcgcttgtcccgatctgataccgttccgtggaattaggctttacaatataatctccagacttaaagccatcttctgctcccatttcaatataataattgtttccttcggaataataaatctccgtagggacaaagacaacagaagtccctgattgggaatagatctccttgttaaaaccggtggactggctgtcgccgccctgggtaacatattccatgggaccagataaaaatcttttttcgtaacggccgtaacaggaatctttaatccatccacccggtcggaaactatttcaaagtcaacataccggtcagatgcaaattgaaccatgtacttatcaaaatccagttttccaaaggtttttccatcggttccggtcaacacggaaaagcttccggatgcccttaacccccgcccggaaaattctatggtaagacttgttttgtctccgtaggatttggcgtcttcttctgtcattggaaacacaatggaccacaaatcggaagagatgattttatagacaggagcgcccttttctatcagttttccggattttgtaatggtctttgtataggtgctgcggtcaaatgcagtctctgagatcgcatttggctgaagtccttcataggaatccactccataggagacaatgcccgccttgtccgcttttacctgttcaaaattaatgcccgcctgatccatccggtctccaaggttatccagagcattaaaattcatgtattccatgacttcggcttccagggcgtatttcgtatcatagacggaatggaactggttattatcataagtaaggctgaatgcggtcagctgctttttcagttcagaaagattctccggagtcagtgtaaccttttcctctgaattttctgcaagaaaagaggtgagatttcctgtctcgtcaatggaataaacccgggtgccgttggaagcccgttttccttcccttacatagtaattcacatagccggaacggtctgcattcttcacttcttcctgccggaggatgattcccgtgtagttcttgttattaacgatactgccttcctgtacttcataaaactgtactttatctcttcggatataggcagtaacactgaataccatataaacaaagatcaacgcaaagatgatcatgccaacattaatattcagaggccgccggtaccggatgatctttttattcttctttgggtgggcagcccgttttaatggctgcagtaccttctgttttaccaacctggcgcctcctttccctattcctgcccatgctctctgggcataaaggtatacccgtagggtgtttccctatttctgcccatgctctttgggcataaaggtatacccagggcattcctttctagtattataaaaggaaaacccaaaaaattcaagcaaaacaaaggagactgccgtgcagcccccttttctttcatgtatgattataatgaaacaaccacattggccttggcattctcaggcatattctctgcatccatggaaacgctgagaacaaaggttacgtgatacttttcaccgattttttccaaagttgcaatggtctcagaaatgtcttccccttctaagcaggccagctttaaaaagctgtcaaaaaacatcatttccaaatcatgatcctgggatatgataccacagataaaacctataaatccttcgctggatgtaatcggatactcattgacattaatgagacggatcttgttgcttaattcgtacatatgcttggaacttttgtccaggtacgcaatagaaccctttgattcttttacaatggaattagctctgtctaacagatgttttgtcttccccttacccttttttcctgctattatctgcaccatagcaatctcctccttgcgttatataatttgtataaaaagtctattcggattaatataattatagtacaaatcaataagaaaggcaatgactattctacaattttattcaatatatttgtcatattatcgtagaggcctgcatggttgggcgcttttaaaactacggtaacatattcccgatcagcggaatccgagcttcccatgatcagacagcttccggccgcttttgttgtacctgtttttcctcccaggacggtaaggccctccggcatcttccgctctcctgtcatataccagttggtacctttccaggtggcatttaccgggtttcctgctccatcctgataggtggcagcatattctgttgtatcgatgatcttgcgaaattcgggatactttaaagcttcgttgaagattaagtacaggtcataagccgtagtatagtgattttcatcgttcagcccgtgagggttgaggaaatgagtgccagtggccccgatcctcttcgcttcatcattcatcatttgagaaaactgatcaattccaccggccatatgggttgcaatggcagctcctgcatcatttcctgaaggaagcatgagaccatataatagctgttccatggtgagcttatcccccggccttattccgcataagctggcaccggcttccgtaatgacggcatctccggttaccgtgacctcatcggttaagtttccgtacttcaaagcaataagagctgtcatggtctttgtgatgcttgcaggatacagccgctcaaaaggattctttgcaaacaggacctttttatctgtcagatcaaagacagcggcagcttcggcagtgaccgcattatcctggccggaagtatcctctgccacgatgcagagatcatgggcaaagggctccgatttgcctgacactgcactggactgataaagagcggtcctttctgaaaacacataaggattttcaaggctctttaaaccggcgcagcctgtgagaaatacactacataaggcaatgcagcctgattttacaaaaactcttttcttcacggaatctacctctgttatttatacatctcacgccattccaagtcaccgcgatccagagacttgatcaaaagctctgcggtggccagattggttgcaagaggaatgttgtgcatatcacaggtactcataatgtttacgatatccggttcatgagactttggtgtgaggggatctcttaaaaagatgaccagatcgatctcattgtgttcaatctgggaccctaactgctgctcaccgcccagatgtcctgccagatacttgtgaacatttaagtttgttacctcttcaatcagacgtccggtagttcctgtagcatataacatgtgtttacttaaaattcccctgtaggcaatgcagaaattctgcataagttttttctttgaatcatgtgcaactagtcctatattcatgacgatatacctccttattaattaccgattttgcgttgaagcccaacattcagtaccaatcccatacccataaaaatgctgatgagcgaactgactcccgagctgataaaggggagcggaaggcctgtattgggaaatatttgtgttgccacggcgatattggcaaaggcctgaaagccgattaaggctgccatgccggtacaaatcagttttcctgacatatccttggatttggatgccaaataaagacattcaaatacaaccaaaccaataagaacaatgacgataacgctgcctcgaaatcccatctcttcgcctataatggcaaaaataaagtcggtttctccggctgataagaaatttccatctttcaccgatgcaatggttgtattaaaaagtcctttcccttgaagctgtccggaactgattgccataattgaatttttttgctggtacagattttcggcatactgctctgcatgaggataaatccatgcaaggatacgccgtgcctgatagtcgtggataaaagggatcagacccttagtcagcagaaatatgaaaagcgctcctgccggtattgctacggcaaggacgccgccgatccaccggtagctgattcctgcggaaaataccatgcacagaataatgatggacaccacaaggctggtggataagttgggttccgcaaaaataaggccgatgggaatggccgcaaacaaggcggccaagcctatcatcaccggcgtgttcagcctttcctggtatttgctccaataccaggaaaagaacacgattaatccaatttttacgaactcagacggctgtatccgtccgataccgggaatgttgatccacctggtagcccctccggccgtatgtcccataacaagaacagcacccagcaaaaggatgcagactgcataatccagagcataaagctttatgagtttatgatagtctatgatggaaagcccgatagcaagggcaaatcccaccatcacgccgataatctgttttgtcactgtagcagaatcctggttggaggcgctggccaccacaagaattccaataacggacagcgacagcatgtacaaaactaaccggtaattatagtatttaaaattgtagtcagaaaacataattagtatatccccttttcaggtacatcgcgaatagggatgtttgcataaagcaccggtgtaaagcgttcgcaatccggctgtttcagctttttcatctgtatctctattctgtcggaatctatatccatgtatcttgaaacaacacggaccatatcgtcttttatcatctgcatgatctcaggagaacaatcagccttgtccgcaaccagcaaaagtttcagacgatttcttgcaatttctcctgaattcttcttgcggaatacaggaagcaggctcataccacaccctcctatgctctttttaggaggtgcgagagcttaaagaacaggccttcacgcactgccggattatgaagggggatattttccccggtaatccgcctgcagatatccatataagcctgtccagccggggttcccataccaacaagaggttctccctggtttgaggaaatgacgatgtcctcgtcatccggcacagcgccgataatatcaacggcaaggatgtccatgacgtcgtcaagagacatcatgtctccccttttcaccatatccgcccgaatgcggtttacgatgagttcaatggtccccatgtcagcagcttccaaaagaccgatgatccggtctgcatcccggattgcggacacctccggggttgtcacgacaatggctctgtcagcgcctgcaatggcgttttgaaagccttgttcgatacctgcaggacaatccagcaggatataatcaaactcttctcttaaatcatcaaccagcttcaccatttgtccgggggtgacagctgtcttgtccctggtttgtgccgagggaagtaaaaataagtttgggtatcttttgtcttttatcagggcctgcttcatacggcagttcccctccaccacgtccactaaattgtagacaatgcggttttccagacccataacgacatccaggttccgaagtccgatatctgtatcaatcagaactactttcttacccaggattgccagtccggtaccaacattggcagaagttgttgtcttgcctaccccgccttttccagaagtgattacgatgatttcgctcatatcatatcctcctgatttttataccatattctattttaccttaatttttggaatatttccacactttttttcattggtttaattatgactttgttattttccatataagccttcataggaccccgtcccaggcgcttgcctcttccgtcaagacctgaggtacaatctgcgatacgcagttgaatgggagccatatcaagagctgtgataagcgcccccggttgcctgccacacctgcacataccgttccggaaagctttccgagaacgattacgttgccttttgccaaaacctttgatcccttgcacacatcaccaatgatgacaatgctggcttcggattccaaagtctctccgctttgtagattacctttgaagaactggcctgtctggcaggacaattccatcagtttctcgttcagtgctttttcacagcgctccatgcggtttatatccgtatcaaccaggcagatgatctccacattggaattttccgtgatctggttgatgattgcgaattcttcttcggaagtcagttcccggccctccagggtcagggtcatttgtacggatccccagaattttgcatgatccccgaattttttcccaatatcagaaagaagctgagggaaggggatatctgggtccaggatgacagtcatacctgctctgttgcttttaattactacggtattatgcatcatatcacctcttatcctagttaatcgcgaatgttgaccttcgctgcatccagggcgccggcatttataatggattctaagtccgtgtagccgtaataatacttatagacattcttcgcaatattggcggcgttggatgatgaatagccatacggaatattcacggtaacacagatttccggattgtcatatggcgcataggaaataaagaatgcgtgattgggtttgttgcgggcttcctgagcggtaccggtcttgccggcgatctccacttcaagatctgaaaacagccttttacttgaaccatttgtaatcacttctctcattccctgttgtacagtatcccacgttgaagccgccgcgtcaatatgagaagaaatcttaggggtataatcttgtatcagattgccttcagaatccgttgtcttatccaataagctgagttcaaacacggttcccttgtttgcaatggcagacacatatctggaaagctgcacgtttgtataagcgtggcttccctgtcccatggcggaacgctccggtgcttctttggaaatctgagggtcaagctctgcgatctccactccggacttgtgatccagtccgaacatggacgcatatttccgtaagacgtcaagtcctaagtcaggagaatatactccgctggcatccattgacaaacggtgtcccagatcagcaaagaaaaagttacaggaattttcgattccgcctacaatatttaaaggaccatgctggccggaatagatccagcacttaatgggcggttctacatccgtgtaaatacctgtacagttaatggtttcatctgttgtaacggcatgctcttccagagcggccaccgcagtaattggtttaaaggtggaaccaggtgcttttctcgtctgggtggcattattgtatagcggcagagacaaatccgcctgcagctgactgaaataagtgccgtcgccgatccggttgttgtcatatcccggataagaaaccaaagcaagcacctcccccgttttatcgtttgtgaccaccacacctgcattacagggagataacgccagctgggcaggcgtaatttccaaggtggacagtttcctgatcagaaaggcgtaggcatcaccggtagctctaagctctgcagcatcctgaccattgtctgttaaaactccctggtcgtataaagcaaggcatagctcctgtcctgtgatgatgtcatcgttgatcagataccggtatatccttttcgtaaagttccggtcatcctttaacttgtccagcacatagtctataagagctttaaatgtgtcgtctgcgctagaatatttggagccggtttccagtttggttgtgtctacccagccattggctattccataatacaaatagtcccttaagctgatctcatctgctttccatgcctgatattccccgctggaggtatcaatggcgtcctccttgatgattcccaccgtagggccggaaaggtaggtatatatataaaacatataggctttcatatcttccgaaagatccttcatggctgtggcatgagtgctcatcagctcattgtttaagttagtaaaaatctgctgttgggaagacatatatttccgatatatgtttttttcagtttcagaggcgtcctctccctccatttctttcagggaaagaacattgttgttgataagctgataataagcatccttgaccgggatcttcatattggaaccgtcggtggtacttcctgcctgataatcaccgtttacaatggtcttaatgagaacgcctgccaaagactgttcaattaagtggtaaatgcctttctgaagatcggcatccagagttaaaaacacatcatttccagcggaagcgtcggtttcatcctttgtttcccgtatccggcctacgctgtccttataaatcgttttcttcccttttgtgccttgaagctcatgctccatggtatattcaataccggcccgccctacggtgtcattgatatcgtaatcgtctttcttcttctgaaggccttccaattggtcctccgggacctttccggtgtagccgatgactggagcaaaaggaatgctgtcattgtaagcgcggatggtggtctcctccacattcactccctgcatttccccaatgtgttccagaatatccgccacggtttcatcggatacctggctggcgactgtagtggcttcatatttacggtaggacatgaggcgaagggcatatttgatgttgataatgtccagtgcttcctggtctgtcagggtaacagcctttccatcctgatctttcatatctgtgagtccactgtccttgcaggcccactcaaacagctcgcgtgcgcttaaatttgagggataggagcctttttcatcatctaagtcttccactttcttcagaccgtaatagtcccgcagaaagcgctttctggcagattcggaggaagaagtataaaccatatcaccgttgggatcaatggcgatttcaaattttccctgtatggtttccccatgtttttccaggatctgtaccaatcttaagtacatgttgtttctggcggcagcattcttataaactcctgtatcctgtacggtaacagaataggccagcttgttataagccaagactttgccggtccggtcatagatattgcctcttgttcctgcagttgtaatggtctgttccgtaagctgtaaatattcgttaagagcttcttcgccgttgacgatctgcatgttgaaaagtttatttattaaccctgcgtacataaaaaaacagatgattccaagtataaaaagccgtgaagatactgcttttttaaaagtttcctttatgatgtctaataaatcactaaacaattgccgaatcacctctttttcctatctcttccaagtgccggttcaaaatcaggaatacccgataaagaagcaaggtcgttacgacggtaaaaatgatttcaggcagcatcagattaatgaaataatatccgactcgaattttctggcggatcaggaacctgaaaacataaatatacaggttataagccaattcgttcagtacgctcagaattaaaggcagtgtaatgtaatcttcataatagtatttggtgcagattccgttgacatagcccacatagatgaaaatcaaggtgtaaaaaccaaaaggcccgctgtaaaataaatccatgagaagcccggccaaaagcccgtaatacatcccggcctcttttccatgcatgaaaccaaaggaaaaggtgaggatcaggagcaggttgggagatgccgataaaaacggcatcaacggaaaaatgcagttttgaatggtaaatgccagaattatcatcagcacattaaaaaatatccgtctcatgttgctcctttcattattatcgtccatgctttttggacatagagggacacccgaagggtgtttcgtcgttattgggcagtagtttctgttgtttctgcctcagaggaagccgcatctgggggggccgtttcctcttggggggaagctgcttcttccttcatcatgtcggatttcagttccgtgatcactaagacctcctggaggctgtcaaactttgcggcaggaatcaaatatcccgatttggtaacgttgttggtatcattggtaatttcggaagcataccccaccagaatgcccggcaggaatacggaactgatgttggaggtcacaatcttatctccgtcttttaaatcgctttcctttaacacgttggtgatccgcagccggccttccttaaacaaggtcaggtcacctgcaacgatgcagctgtttccagactgcatggccataccgctgacacggctggaatcatcaataatggagcggacggtggcataatttgctcccacatccgtgacaatgcccaccaggccacctccggccacaacattcatatccggggcaatcccatcctttgagcctttgtcaatacggaacacctgaaaccagttgctggagtcattagcaataaccctggctcccaccttatcatactggctgtattcctgatccaggctgtaaagctgccgaagccgttttagttcgaattcctccgactgaagcctggtattctccgctgtcagctgggtgatgatatccttcatttctttattttctttcattgcatcgtgaagctttgtgtaatcgataatttcatcataaatggccgagccaaccgcattgactcccgattgcaccgggatcaggacatatcccaccccggtccgaaggggcgtcagccattcgtcatgaatggaggtcagcccgatcaacaggacacaaaataccgttaaagcaatgagaacatatttgctgcgctttgattccatctataaaattccccgttccttcaaactgatataggaattatctcctatgataatgtggtccaacagccggatgccaaccagatctccagcttcctttaccctgcgggtgaaacttaagtcttccttactgggagacggatctccgcttggatggttatggaccagtaccaggcttactgcatgatatttcatagcctcaatgaaaatctccctgggagaaaccgcggaagcattcaccgttccctgagagatcatgatgtcccttatcagggctccttttgtattcaggagcgcaatataaaccagctcctgttccttatggcgcatatcttccacaaagtaatttacaatatcaaggggactgcaaaatgatgtcccatgggtattggcggtccttttccagattcgcctggaaagctctcccacacatagaagctgggcgcctttgacggtcccgattcccttgactgacataagttccggcattgaaagatgcaaaagccctaaaataccctctttgggataatttaaggccagtatcttctgtgccagcgccagggagttgctctccctagaacctgtgcggatgataatggataaaagttccgcatcgcttaagccttccggcccttcctttaaacacttttcatagggcctttcatccgtagggatgtctttcatcgttattcgtttcatatgcctcctgaccgttactctccaggcaccttaagaaaggacatatgtaggacaaagcggacattccaagtccaatccacttcgtttcttgctcatgaactcaggcgttcaaattaaccgatacataatgagggccgccgccactcctatgatgccagccatggtaattttaatattgatgccaaaggtgattaccagaatgccgaaattgaccaccaggggagtgtcaaatccaaaagcttgtcctgcattcagccaggacagccatgaaatcccctgagccaggtttccgataaagcctcccagaaccacaccggccagcataagaagaagcagtacccagcagtttttgtatttcatctgctttgttaccccttttggttttatgacaaaaatgtccatacctatcaaatcattctaacatagttttccaattgtgtataccgtttttttacaatttacctccaacggtcgggtgcagaaacaagcttcagcatttgacccgcagcacagaagtaaagatttgtttttacacctggatcaagcctgcttccaaaagcttttgcactgacattagtattcccaattttgcgtggtaccaggtaagacctccctgaaaataaactgcataaggcggtttaatagggccgtccgcgctcagttcaatggaagaaccctgtacaaaagcgccggcagccatgatgacaggggcatcatagccaggcatatcccaggcttcaggagtgacaaagctgtcaacaggagccgccgcctgaattccctggcagaatgcaatgactccttccggctttccgaaggtgacggcctgtataatgtcgtggcgggactgggagccgtcaggcaccacagaaaagcccaggctttcatagacattggcagcaaaaacagctccttttaaggctcctgcaactacggtaggagctaaaaataacccctgaaaaaaggactgattaaggcccagagtggcccccacttcctttccaaggccaggcgctgtgagccggtaggaagcccggtcaatgcaatcagtctttcccgcaatataaccgccgataggggcgattccgccgccgggattctttatgagagaacctaccaccatgtctgctcccacgtcggatggctcaatcctttcaacaaattccccataacagttgtcaaccatgcagatgacatccggtttcagcttctttatgaaggaaatcagctctccgatctgagcaacggaaaaggtaggacgggtatcgtaacccttagaacgctggatggtgaccagttttgtcttttcatttaccgctttttctatggcttcatagtcaaaggttccatcggtcagaaggtccacctgtctgtataccacgccatattcctttaaggagccaacactgtccctgattccaatcacttcctccagggtatcgtagggctttccaaccggcgagagaagttcgtcaccggggcggagatttccggaaagggcaacggtcagggcatgagtcccgctgatgagattcggccttacaagagcgctttccgtgtggaatacgctggcataaaccgcttccaaggtgtcacggcccaggtcattatagccatagccagtggtcgctgcaaaatgaatatcactgacccggttctcctgcatggatttgatgaccttcatctgattgtattcagccgtttcatcgatttcttgaaaccggtcctttaaagcttcttcgatctcttttcccaagcccatcacctggctgctgattcccaggctttcgtacattgcatttatttccatggtttattattctccaatccgtacatctcatatatatcctgtaaaatttttaaaagcacctgatccaggtcatggttaaaatcaggaaggttcagccatctcacatcccgttcccgcttaaaccaggtgatctggcgcttggcaaaatgcctggtatcccgcttcagcacatagacggcctcttccagtgagtatattccctgtaaataatccaggatctccttatagccaaggccctgcatggaaaccatgtccctggacaggcccatatcctttaagtgcattacctcttccacaagcccctgctcaaccatcagatccacgcgccggtcgatccgctcatagagcagggcccggtcagtattcactacataaaaaagaaaatcatagggggactttttctgcttttcccgtttgttgtgctctgagatttgctctccggtctgtcggtaatattcaatggcccggatcacccgtttcatattattctcatggatctcagctgcggaatccgggtcaatgtccttcaggaggctgtggagaaaacttactcccctctcctgtcccagcttttccaattccctgcgaagggaagtatcccctccatcttccgtaaaatcgatgtcataaagaagggactggatgtaaaaaccggttccgccggccacaatggggatatgtccgtgggaataaatctcttccacggcttccttagccattttttgaaaaaccgtcacattgaattcctcatcaggatcaaggacattgatcagataatgaggaacaccttccatttcctcctttgtgatctttgcggagccgatatccatatggcggtatacctgcatggaatcagcgcttataatttctcctcccaccgcctttgcaaggcggatggacagggcggtctttcccacggctgtcggcccggttataataatcagcggtttcattatacgatcctcttaaattttttctctaattcatatctgctcatggaaatgatcgtcggccttccgtgtgggcaggcataagggttttccaggcttaaaagctggtcaataagctcattggcttctgctgcagataagctgtgtcctccttttaccgctgccttgcaggataaagaggcaaccttctcataaatgatatcaggattatgggatgagccatcctctgacaatccgtcgatcatctcaatgagaagttctttttttgcaatagaaaataagttggccggaacccctctgaccgcatattccctgccgccaaaaggctcgatttcaaagcccatatctgtaaaatattttaaatggcgttttaataaaacctcttcattctgatttaaggtcagaatgataggaggacttaccagctgggaaatacattccatatctttaagtgttcccatggttttttcatataaaaccttttcatgagcagcatgctgatcaataatatatagctgttcattaaactccaccagccagtatgtattaaacagctgtccaatgagcttatgtaaggaccgggcctttggttccagaagttttccgtcaaacagatccaattgctccggctttttttcctgctttgcggctaccgcttcctgtggactttcctgtcttactgccacttcttccggcggattttcctgttttgccgccgattcttctggcggagctgtcaatggcctttgaaaggccgcctgggcctggggttttaaccagttatccgacagatcatccctttcctttacaagagaaggctggggaggcgttaatcttttggggaagaggccggctgtttcccttttttcttctgtaacagcctgctgctccatggccataaggcggcgcttttcaaaaggctctggactgggctcgtgtttttttcccgcaaagccctgtttttcctctgcctttttttccagctccacttccgggatcagttccttgtgggcaagagcgcttgctactgcctggtataccatgtgatagaccatttccccatcccggaaccgaagttccattttggtggggtggacgtttacatcaagcatttccggctcaatgttgaaatgaagcatggtaaagggatatttatgctgcatcataaacggcttgtaagcttcctcaatcgccctggaaataatgctgcttttaatgtatctgccgttgatgaaatagttttcgtaatttcggttgcctctggcaatcaccggctttccgatatagccgttaatggaaacctcggattttttcacagcgacctgcagaagatttgatgcgatttcccggccaaagactgtgtatacaatatcctttaaattgtggtttccggaagtgtgaagcttgttctgattgttctgaataaagcggatggatacctctggatgggataaggccagcttttccaccagctccgccacatgggcgccttccgtcatgggcgtttttaaaaacttctttctggccggagtgttataaaataaatttctggcaataaaggtagtcccctcaggagctccgatctcttccagggaccgttcctggcctccgtcgatctggtacctgataccggtaagtcctatgctggttttggtaatgagctccacctgggagaccgcagcaatgctcgcaagggcttctccgcggaacccaagggaggaaacggtaaataaatcctcaacggatttgatcttgcttgtggaatggcgcagaaaagccagagggacttcctctttttggattccgcagccattgtcggtcacccggataaaggaggtccccccctctttgatctccacggtgactgcagtggcttttgcgtcaatggcgttttccaaaagctcctttacaacagaggccggacgttctatgacttctcctgccgctattttgttgatagtattttgatccagtacggttatattcggcatagcacctgctcctttccacttatttgcccacgctttttgggcataaaggtatgcccgcagggtgtttccactcatttgcccacgctttttaggcataaaggtatgcccgcagggtgttacctactgccagcggtttttaagttttgtctgcaaacggtataaggtgttgagcgcatcaatgggagtcatgtttcccagctccagatcgcccaattccttgatgatatcatcgtcctttacggtgtcaaagagggacatctgctgtaaatccacttcatctggcctgggaaccgcctttctctggataatgttggcattgcccccggcaatttccctggctttggccgtgatgtccgcgtcacttaattctgccagaagctcctttgccctgacaatgacggaatccggcacgccggccagctttgcaacctgtacgccgtagcttttatcggccccgccttttatgatttttcttaaaaatacgatgtcatcaccctgctcttttactgcgatgcagtaattattcaccccgcccatggttccttccagctcggtaagttcatggtaatgggtcgcaaacaaggttttcgctcccaggattttgggattgctgatatgttccaccacggcccaggcaatgctgagcccgtcaaaggtgctggtgccccggccgatctcatctaagacgatcagactgttttttgtggcattccgaagaatgttggcaacctcggtcatctccaccataaaggtactctggccggaagccaggtcatcggaagcgcctacccgggtgaagatccggtcgcagattccgatgcttgcctcttctgcgggaacaaagcttccgatctgagccatgaggacgatcaaagccgtctggcgcatataggtagactttcctgccatgttgggaccggtgatgatggaaacccggtttttaccgttgtccagatatgtatcattggaaacaaataagtcatcccgcatcatcttttctacaaccggatggcgtccgtttctaatgtcgatcagccccttttcgttgatctgaggctttatgtagttgttccttgtggcaacagaggataaggaggtcaggacatcgatccctgcgatggctctggcggttttttgaattcggagaacctgatctgctaccgaatcccggacctcacagaataagctgtattccagggaaaacagcttgtcctcagcacccaggatcacatcctcaagctcctttaactcgtcagtggtgtaacgctctgcgttggcaagggtctgcttgcggataaaataatccggtacaagatctttaaaggaattggtcacttcaaaatagtatccgaagactttattgaatttcaccttcagatttttgatcccggttttctctttttcccgcagctccaaatcagccagccagttctttccttctgtctttgcgcttcgaagtttgtcagcttcttcatggaaaccgtccttgatgatcccgccgtctcttaaggtcacaggcggatcatcgataatggcattattgatcaattcactgacatcctctaagggatccagttctacccacaaatctttcagcatgtcgctggtgaattcgtttaaaatgtttttgatatgagggagcatttccagggagcttttaaatgcgattaaatctcttggattggccgttttgtagctgatccggccgatcaggcgttccaggtcataaatgggatttaaatattcgcagatctcctcccttgatatgaagttcatattcagctcttcaatggcattctggcgttttatgatctctgacttatggatcaaaggctgttcaataaaggtgcgcagcattcttgctcccatggctgttttcgtcctgtccaggacccatagaaggcttcccctcttctgcttttccctcaaggtttccaaaagctccagattccgtctggtagaagtgtcaatgatcatgaactgcccggtggaatagggggtaatggttgttatgtgggaaaggctgtttttctgggtctcgtacatgtactccataaccgccccggcagctatgactccggtgtcataatcatccagtccaagccccgtaagcgcgcctaccttaaagtgttcttttagaattttccggcagacttcatcggaaaagaaatgatgatccagagatgaaatgaccgcatggtggcggttctttatttcctcaatatccactcctgaaacataaaatgcttcgttgcagataatttcagagggggtaaacttgttgatctcatccgtcagctcccgctccgattctacctcagtcacaagaaaatcgccggtgctgatatccgcaactgcgatcccaaaggtttcacccacatagacgattcccatgaggtaattgttttttgtttcgtcaagtgcctgggcgcttgtaatggttccaggtgttaccacgcggatgacctcccgctttaccagccccttggcaagcctgggatcctccatctgctcggcaatggcaaccttatagcctttctggacaagacggtttaaatatgtatcaacggcatggtaaggaacgccgcacataggcgcccgttcctccagtccgcattcctttccggttaaggtgatttccagctcttttgatacggtgactgcatcttcaaaaaacatttcataaaagtcccccagtctgtaaaacaggacacagtccgggtattccttttttgtttccatgtaatgggccatcattggtgacaatccagccatgctcttttacttcctcttttctttctcttctgtttatggtcttaaggttcccatgtagtaaaatcctctggattcatccagatatacgtccacgatttttccaataagtgaggaatctcctttaaaatgaacggtagtattattgcccatgcggccggttaaaagaccttcctcgtgatcatttttatcttcaaccagcaccttctgaacggtgtgctcatcttttccgcagacttcggaggatatcttctgaacttcagcaagcagacggtcaaaacgtttcttcaccagttcttccggtacctcctccatctttgctgccggtgttcccgtacgcttggaataaataaaggtaaaggcactgtcaaagcgtacctttttcaccacttcaagggtttcgttaaaatcttcttccgtctctccggggaagcctacgatgatatctgtggtcagagaaatatccggcatggctgtccggattttttctacaagctccagatactgttccttggtgtatttccggttcatgacctttaaaatccggctgctgcctgactgaagaggcaggtgaagatgattgcacaccttttttgagtttttcatggcttcgatcagatcgtctgacaaatcctttggatgagaagtcataaagcgaatccgctccaggccttccacctggtcgatctgggtcagaagttctgcaaaggttacgggtgtttccaggttttttccatatgagttgacattctgccctaaaagcatgatctccacaacgccgtcatctgcaagctgctttacctcctctaaaatgtctttggggctgcggctccgctctttgccccgcacataaggcacgatgcagtagctgcagaaattgttgcagccaaacataatattaacgccggacttaaaggggtacttccggtccgttgggagatcttccacgatccggtccgttccttcccagatgtctacaaccatccttttttcttccaggcgttcatacataagctctgccagtttaaaaatattgtgagtgccgaaaataatatccacaaaccggtagctctttttaatcttggcaactactttttcttcctgcatcatacagccgcaaagagcgatcatcatatgaggatttttcttttttaagctgtttaaatatccaagacgcccgtaaactctgtcattggcattttctctgaccgtacaggtattatatagaacaaagtccgcctcttccgtatcggtttccacaaaaccgattgcttctaaaattccctgaagcttttcagaatctctggaattcatctggcatccgaaggtggcgatgtgaaaggtaaattgttctttccctgatgatttctttaattgatccagaatatcccggtaacgctctataaaatagtactgtcttgcaggttcttcctttggtgcctggctgagggcttcctcataagtcatatttataaaatccatttgcataacctcttaatttttattcggttttcccattatatcataaataccttttattgcaaataacaaaatcggcttttccaatggaatacccctttagatgaacggtaatatagaaaagagcagcagccaatttataactccaccaccccggtggccaccttacgggtaaacgcatcgtcatgctctacaagcagcatagtcggctggaacttaaggatcagatcctcgatctgaatcctggaatacacatcaatgaaattaagaggttcatcccaaacatacagatgggcctgctcacagaggctgcgggcaataagaacctttttcttctgtccttcgctgtaggattccatcggcttctccaattgctccctggaaaagtccagcttgcggagaagcgccttaaacagggaatcttcaataccgctttcccgggaatattccgtcagactcccttgtaaaaatgaagtatcctgggatacataggatatcctaagaccgctggctatttccttatccccctcataggagatgctctcgcctgtaacggcttcacctaggaccagcttcagtatactggattttccgcagccgtttcgcccctgtaaggatatcctctgtccctgttccagagtaaaactgacaggttcacaaacaggcacctcatagtatggaaccacattttttaaggtgagaattcttgacgagcggtattttaaaggataaagcttaaggctctccccttcttcaatgtttttaagcaggtcttttttatcatcaatggcacggtcctgtctgcgttccagattctttctccgcatctgcatccgtctggacttttctccaacataagcccgcgtaccaatggatttttcgtgtatcatggacttttttccgatttttgttgattctacctggtccgcccattccccggattgccttgcggccgcctccagatgcctgatgtccttttttaaacgttcattttcagatcgttcatactgatcctgcatctgcttattctcataccaggaagagaaattgcccttctggatctcaatgttggttttgtttatggacaagatatggtccacggatgcatccaggaagttccggtcatgggacaccaggataaatccctttttactgtttaaatactggcttaccagttctctggcttcccggtccagatgattggtgggctcatcaatcagcagaaagcggccttctcttaagaacagggctgctaagaggaccttggtcctctccccgtttgaaagcgtgtaaaagggacggtatagcacatcctcagaaaccttcagtttggacagctctcttttaagctcccagaaaggatactctccaagaagggaatccagaatttctaaagtattcatctcctcatccggtacaggaaatgggaaataatcaaacaggacattggaaataatggttcctgtgtatttgtaacggttcatcagaagatttaaaaatgtggtctttcctcttccgtttcttcctgtgaatcccagcttccaatccgtatcaatctgaaaggaaacgtgctcgaacacgggatccgggcttccatcgtaggtaaatgacaaatcagtgacctgtattaatgacatagatattcctccattcaggcaggaaataaaatttccgcacaaaaaaacgactgcaagaatctttttctcacagccgtccgcatcaaaataagccctttgggcaaaccttccgctctttccatgtctcattatgacaggaaaaggtatgagaatgaaataatattcttgcaaaaacaggcatgacaaaaaaagacaatgtcctttccctcttatcatgcagttacttcagcaagaattattaattcatcctttcacctcatttcgtttaatatgcccgtagtctatcataaatatatggaattgtcaaataatacttaaagaaaaacataagattaatcatagtatgcacgaattcttcctaattagcccgtcccgtaatggtaatttctacccggcgatttttggctctcccatcttccgtatcgttggaagcaatgggattataatgagaatttccctcaatggacagctgccaccgcatctcccagattgtgcccggtgacatgatttttcaaagcctggtatgctcattgatcaatttgataaaatccagcgcatcatcagcgggaaccatctgggccgtaataattactccctgttttgacagataaagaaaatctgcaatatcttcttctgatacactgacggcctttttcagcattctggtattctgctttcctcccatatttcctacattcacttgatccatgtggaagccagcatcgtaaagcctgcgcatggttttggggcttttggcgaccagaaagaccctttcctcctggtattttccggcacacagattggctgctgccttttctaccgtaagaattgacagcttacactgcttcgggcaggccagcttaagagcctccttattgattgtatcctttacaacctgatcatctaccaccatgatcctggttgctcctgtaacctggctccagacagttgctacctgtccgtgaatcagacggtcatcaatccggacatttacaatctccatcatcaaatagtcccctttcatttatcttttacggatataaatacaggtgaggtccaggccgcatctccatttttctgccagatacgaagccgtaagtttccgctttgttccatccggatccttctttttccggtaaccttataagagttttcgggatacgccttgcctacgcggattttataggcattatgccaccatggatcatcccggtaatgagtgatctctccccaatgttcctttgtaaggctgttcacttcatcccaaagagccatgacctgggagctgttaagcattttcctcacaggaaggagatattcctttccattgatgagcaggcgcagaacgctgtccacatccgcttccacctcaaagataaaaccctctgccaccgtcttctccgcgcccatccatttaccggaagccggagactggtatgtggtcatggtaaagctgcagctcttgtcatcatggtgataaatatcctggccatagtgattccagcacggttcaacggaaagcagctttccatccgtctccagacgtccttcccagtcttttataaggtggtcacggtaaaccctggtatccggtccccagccaagctccagacggaatttaaaccggatccgtccagcctgcttctcccgttcccatgtacctgaatgcacaaccatttcctctaagatattatctcttaaaatttccaccctgtctactgctccggtaccttttatgtaaaattctaaatccacttggctgtctgtttcaatttcagagcccattggtgctgaattcacataatagtccacttcaatcctgcttcgggataccccataggttcttcgttttcttaagccttcccatatggactcctttgaacagtcctctgcaagcacacacatgcttccattttcaaacacgccgggaatgctgtggttatcacctgctgcgatggcgccgattttataccctcgttcaaggccattttcataggtcgtctctcctgtccgcggccccatgtgaatgtgtcggtccatggacagaggcccatcgtcattttcactggaaccgtggctggaataaatttctgcaaaaggagaaaatatttcattgtgagtatcccagtttttgcctctggaacctggctgatatgccagatgatgaggaattccaatgacctcctggccctcataggctgccacaagttcctggtaccgcatgggatgctcctgtttcccgtcattgtggaggaaaaacacattatgatctccatccagtccggcaccctgccattcataacccataaacatgggaaatccctgtctgctggcttcttcggtaaagcttcttaacaactcccagtccctggcaatgatttcatcgtcgtatcggtcttcaaccgacagtcctgacggtgtgggacgcatgtaaaacgggtaataagccaccggccagaaatccatctgcttttttatatgctcataccacaccgggagctctttcatctgctcatgatgaatattactgtgcatgtctgtccaaaactttttgtaattcatggaatcctcccattactctcttggatttatgagtgtgttactatcaattttcatggttgcccattcttccggttttttcgccgctccccatgctttcagccgtctatgcccgtatctggtctcccgttcccggtcagacaaatccctgatctcattttttcttaagaagccgttgtcttctgcctctttcataagctctttcagcaagccttctctggtcattgacagatcatgctcttcatcgggatcttcctgtaaatcataaagaccaatggttttatatcctgacttaactattttgtattgtccaagaaccaccgtttctataagcagcgggttgtcatcacttcccaccatctgctgaattcttacaggtccgtttttattgcttcggaaaccactgaaatcaagccgctttccctgatgccaggaataatcttcatttcttcctgcctcttccaaaagtgtgcgggatacatctaaaagacttaccggcatttttgttatacccggagatatccctgtgcctgctgccagcagcgggacacgaaccgcagcttcatacatggtctgttttccaaacagttttcgttttccaagctgctcaccgtgatcggaggtgtagaagaataaatattcccttccgttttcaacagaccggattttatgataaagctcccctacataccggtctaactgttctaccagaccgcaataagcggccttgcagtttctcatatgctctggttcacattcctgcagaaattcactataaacaggaagagaaggaagccttgcctccttttcacactcctctgcagaaaagcggctttggtactttctgtaatccttatctgcacaggtaaagggaaaatgagggccatagaatccaatcaccagaaacagcggttttctattttcctttttccttccccaattctcaagaaaatccatggccgactgaaataccatctcgtcataaagcataaccggggaaattccccctccaaccccattgaggcagtttttccggttggtagttccggcatacacgccaaaatccaggcgtttttttccaccggttccccagaactgagaggtaatatctccgcaataccgttcatcaaatccgtgcttctggtcttctcctttaaaatgcatccggccggccagaacagtctggtatcccaggcgtcccatttcatgggcaatggtaggtacatcaccgccaagcgcggcatcattattaaaaatgccaagctgtgacggtaattttccggttagaaatgacatgcgcgaagggacacaaaggggtgaattgcaatagcagcgctcaaacagcagaccttcctctgcgacctttttaagccccggcgtttcaatccgttcatccgcaaatcccgtgtaatcccagccgtgctggtctgacataattaaaaccatatctttcataagagaatctcctcagagtcaggcattttccggttatcctgcatttacataattttcaaaaacaccataacagccgcaaacccggtgataccgagaatgatttttgttgcggaccacttctttttatccatcagataccacactgccagcgtaagcaataggggagtattcctggcatgattttatcaaaaatctgttcctgtaaagaaagagacatttcaccgcttacaaactggtaaattacatttgcttttacagtggttgcagcgactccgcctattacgatcagccccatcatggtgagtccggtcgtgattttatccgcaagcgttcggttggtaaaaaataagtttgccgcaccgatacccatattatatcccttatgaaacaaataccactgcatgcctaccacggtggtaagccatactgcgcaaaagaacagagggccaacgggatttccgtcgctgatgcacatgctcatggcaatacttaaaagaatcgggctgtaggtgccgattaacatagaatctccgattccggcaaagggtcccataagcgcatttttggtatttacaatcagctcttcactgacatcttctcccatggcacgggcttcctccatggcaatggtaatgccggggatcagggcgcccagctgaggctctgtgttgaaaaactgcatatggcgctgaagggaccgtttgtattcaccagaatcgtttttatagagtatctttaaaatcggttccagcacatgacaaaaagcaagtcccatcatacgttcaaaattctgggttgcctgtataaagaaaatataagaccaggcagccttgttaatatcctttttagtgagcaatgaattttctcttttattcttcataacagtcatcctcctctgtgctatgtaccggtgccggtacggccgtttgcgttccaccctgggccataacaaagataaatgcaattgcagttgcaaacacagccagtgcagttacagacatactggtagagccgatcagaatccagcccatgagaaacaatacaagcatccatttcctggaaagggactgcttaagcagcatggcgaatccaatggcaggcagcatcttgccggctacctcaaaaaagtgcaggagcccctgaggcatactgctgatcaaaaattctgccagcggcgtgccaaggtaacagatcagcatggcggaacctgcccggagaatgaagcttggaacggctgccagataagtggcacggtgaattccggccccatctcccttttctgcagcccggtctcccatatgagggaaatatgcattgattgtcatgataaagttaaaaagcccaagtcccagcatgctgagaggaacagataacgccactgcctgttctccggtacctccggctgccagtgccagcggaataccgatataggctgcccagttcacatccgcgggcatagcgcctccgggcgtgatctgtccgatgaagagtgcctgaaccatggcacctgcaatgacaccgcctcttacatcacctaagatcaaaccaacaatcaaaccggctacaagaggacgtccgatcatattccagcctcctgtcaccccaaaaaaccacggcgtacgtttgctgcccaaataggcaaatatcccaatcagtaaagcctgtaaaaaagtcatacctttttcctccatttattattcttcgtaatccccttctgctaaagcagattcttcaaactgtaccattgcatttttcccggcattcaagctcttttcggcaatttcagaagaactgtccatggaaggtcttgacatatacccttccagtacggacggcagatttgctccgccgattaccgatattttttcaggttgttccattttcatacggactgagacattaaagggggatcctcctgttaaatccgtataaatcaaaatcccggtgcattgggtaagccgcccggcagccgcagttaatttttcggcaagaatatccaaagaatcttcctgcagaaaatccactgcttcgtaatacataagctctccggccagcagctttagtccgcttgtgattcctgtggcaaagcttccatgaccggttactatcatacctaccatttttacctccttttcaatttccaaaactgatatagtcttctggattttttgaacttgcagccttacactcctttctgtttattttccattctggttttatattaatttcaccttttagaatcggatcccctgtcttttcctgataaaccagtaatctcccgctcatttctttcaaaacggaagcgtattcccggttatataccagattattgcgttctcccggatcatagaggagatcgtaaagcgcttcttcaaactttgtctggttttccagatcctgctttaaaaaataatcttttgtcaaagattcatcaatgttggactggttaattttcaaataggatgtatcgtaatagcggatatatttatagcgcttcgtgcgtacacagcggacaggctcataggatgtatggaagttgatttcagcgaaaatgtcggacctgatttcctccttttctcctgtcagcagaggaaccattgaccttccttccagatattccggtttctccagttcaaggagttcacaaagagtaggaaaaacatccacatgggagacaagactgtctgttacggtcccattcccaaaggctcccggtgaacgaagcattaaattcacaccgatcccactatcaaacagcgtacattttgaaaaaggatttggcaggccgtgatctgttgtaaatagtataatggtattttcccacaatccctcttctttcaggcaggaaatcacctggccaaaacaggcatccgcgcatttcacactcatcagataacctgcaaaatctttccgggtatccccggtatcgggaatcggataaggaggaagggcatattcagggtcgatatcttcatcaattttatcaggaaaccgccgatgagttgcatacattccataagaaaggaaaaagggttgttccttgtcataattcttcatccaccggcagacctcacgtgcattttccttatcccagtccaccagctcttcctgagcatatccggaattatctgtggtcagctcttcctgatagccgatctcggcagccccctgtttcctgtccaggtaccagcccgcttcatgctggattccgcaaagaacggtatggtaaccattgtgatttaaatactgaaccatatgtctgctgtaatccatgacaaagcctctttgagccagacctaacatgccattttgatgcgggtatgtacttgtcagcattgctgcccggctgggcgagcaagtcgggcccgcacaatacgcattccggaacaccgctgcagacctggaaaaggattctatatttggtgtgggaactttataaccatagggacttaatacccgtccggaatcatgagtatgaatatacaatacatttttcactaattgtacctcctgctggttaagcgaggggatattcacaatccacttcgctgtatgctcacagtgtgccccgctttaccgggcataaccgaataacagctatcgctgcttgccaggtagcgcttttattccacctgactggggctaattcccaccaaccatttaatatttttcatatttgaagggttggacttacttgattcggttaaaatgtatttatcactatgcaatatgtattatcattgtcatgaacaatatactataattgtattataatgtcaatacattttgtttaatttgtgttgtcatagagttgctgaaatatccaatcatatgattagcacttctcataatgatttaaaaatgtattgtcatttgcttcaaagtataatacaattaaagaactggtttgataagaaaatgaggtgatgattatggcagagaaaagaattgcccaatataaacagattgaaaatgacctgcttcaaaaaataaatttaggttattataaaaaagatgatctgattcccacagagctggagctttccaacacctatcatgtatcaagggtgaccgttcgaaaagcaacagataatctggtagcaaagggactgctcactagagttgccggagtgggaacatttgtgtgccacccttccgttacattaaaccccagctccattcagggattttcagaggtgatgcatgaacagggaatttccgtccggacagatgttcccacctttatgatccagaaagcgccttccaatatcgcttccatcttaaagatcgaaacaggagaacccatttatttcattgaaagaatccggtatgcaaatgatgaaatatttcagtttgaaacaacctatatgtccagccgcttatatcccgatatctccatgcaggtgctgcagcagtccaaatatcagtattttgaacaggtgaagggaatgaaaattgcatacagcgaccataccgtaacccccattcatccttcaaaaaatatcgctgaaatgtttgggatatctttggacactcccattttgagagttgccaacaccacatatctgaccaataatcagatcatggattatacagaattaacacttaactcacctaaatatcagttgacctacgtcaaaagctgattttcaaaaaacactccatagaagggttaaagcaataaaaacggctgcaagaaatttctttcttacagccatttttatttagagacagcaatctccgtgaaatgcttctctatgttataagggcaaacatgcaggctatggacgtacctgaccgtcaccatatatgatatatttggttgttgtcagttccttaagacccatggggcctctagcatggagcttttgagtactgatgccgatttccgcaccaaagccaaattcaaatccgtcagtaaatcgggtggatgcattgacataaacggctgccgcatcaatttcatttaaaaacttctgggcattactatagtctgacgtaatgatggattcagaatgtttggtgttatagcggttaatgtgagaaatagcctcttccgcagaaccaacaatctttaaggacaggatatagtctaagtattcacggccccaatcgtcttctgttgccggtacaaagccttctgccatggcacaggcctcctcatctcctcggatctcaacggattttaaagaaagcctttctttcaataaaggcaaaaactgaggcgctatgtctctgtgaatgacaagggactcacaggcattgcacacgccgatcctctgtgtttttgcgttgaaaataatatccagggccatatcaaaatcagcagatttgtcgacaaaaatgtgacaattcccggttcctgtttcaatgaccggaatagtgctgttatccacaacggtttttattaatcctgcgcctcctcttggaatcagcacatccacatattccctgagccgcatgaattcctttgtcacttccctgtctgtgtcagtaatgagctgtatggcatcttccggaagacctgcattcctaaggccggtccgaagccattttacaatggccttattggattccagggcatcacttccgccctttaagatcacggcatttcccgctttaaagcatagtccaaaggcatcagcggtcacattaggcctggcctcgtatataatgcctacaacgcccaaaggaacccgcttctggccgatggtaaggccattggggcgtactttcatggaaagcacctctcccaccgggtcatccagtgcggccacggacaaaagtccgtcagccatggcttctactctcgcaggagtcagttccagacggtcaatcagtccggcgctcatcccggaagcagctgccttaatgacgtcctcctgatttgcggtgaggatttcaacttctccttccagcagagcagccgccgctgcctttaagccttcattcttttttgccgaaccaagaatccctatgattccggctgtttcttttgctgtctttcccatctcagtaatcgtcataaaagcctcctccaatcctttccttattattgtccatgaactttgggcataaaggtatacccgcagggtgtttccttattattgtccatgaactttgggcaggatatttccttaatccttaaggagtgataatccggtccacacgtttgtcatgaggttccgtcggaatatggtcaaagatctgaaagccgtaggctatggcaatgcggggatgatctggttccctctcaaaaaaacggtcataatatccgcctccataaccgatccggtttccgtacctgtcaaaagcaattccgggaacaataacaggagcttgcgggtcatgaactcttaaacaggatgactttggttccataattcccatgacgccttcctccagatcggtttttccggaaatggaataaaattccaggtctcttccaacgacctttggcacagctacgcattttccctgctttaataaactctccatgaacctccaggtccccgcttcccggcgaaaggatacatagcagtaaacacaaaaagccctgaggatatcatcaatgcttaaaagctgccggcagatggaatcattccaaacgcactcggctgttgtctccaaagccatacgctgctcttttacgaatatcctgatatcattcttcgccgacttttccatattttttacccagatccgttatggtaccgtctttctcctcaatggaaatattgtttaaatttccccgtaaactattgcggatggcttcaatatactccctccgcaaagcagcctgctctgcagcctctttttctgttaatcctactgactttgatttatgataaagtgtattgatccggtcgattttttcctgattcataagttctccttaatactcgtgattaatatagtccatcaggtcaaagtcatggtttggatgagccaggaacagggttcccttttcttctccctccacgatctgactgatggcctccacctggtctccgttggcaatgaccatatcgcagccgctgtccgtagcaatacgggcggcagccagcttcgcagccatgcctccggtacccacatcgcttcctgaggtggattttcccatatccagaagcttgggagtgatttccctaaccagtccgataaattctgcttccgggttttgtcttgggtcatcggaatacaggccgtcaatatccgataataatattaaaagatctgcccctattagagcggctacaatggcagacagccggtcattatcgccgaaattatccaccagaggaatttcggaggtggatacggtatcgttttcattgacaacggggatggttccaagttttaaaagttcatcaaaggtgttctgggcattgtaacggttgctgtcattaaccatagtatttttggttaacaggacttgtgcagctatttgattgtattctgcaaaaagcttctggtacaccatcatgagcctggcctggcccacagcggcaaatgcctgcttttccgatatggtaacaggcctggtatggtgtcccagagcctggcgtcctgctgcgatggcaccggaggaaaccaaaaccacctgtttcccctgcccctttaagtcactgattacacgaaccagtttttcgattttcatcaggttcagatccccggtgtaggcatgggttaaggatgaggaccctatctttattacaatcctttttttgtcttttagtttctctcgttcctcgacgttcatcttcattatcatctgctttctgtaattctttttgtttcatatcttacatcatttttatgatttcgtcaatttataaaggaaacccttgaaatccggtagcaatggcttccgctaccttcaggccatccattgccgcagaagtgatccccccgcatatcctgcaccttctccgcagggatagattccttttacgctgcattcaaaagcttcatctctggggatcctgaccggggaagaagtcctgctttccacgccggccaaaatggcatcgggcctggaaaagccacggatccggtgatcaaaggcctccacaccctcaatgagagattctgataaatattcgggaagaaactctcttatattggcaaatccacaggcgcctttaaaagcgggttccacactgccaaagtcttttgaaggctgattctttttaaaatccccgtaaagctgaaccggaatttttccgctgcagcttaaaaaagccgcctcttccaactgcctttgataagcgataccggcaagaggggttgtatttccaaagtcttcgggtgttacggtaacgatcaaagcgctgttggcattcacaccatcccttttgtgataactcattccgtttactgcaagccttttttcctcagaggaagcgttgaccacatatcctcccggacacatgcagaaggtataaacccctcttccctttgtacactgatgggtcagcttgtaatccgcagggccaagtatagggtggcttccggtcccatactgagaacggtttatgctttcctgaggatgctggatccttaagcctactgcaaaggcttttgcttccatgggaacttttcttttattcaggatttcaaaggtatccctggcgctgtgcccgatggccagcacaagaacctctgccatgatccgttccttttcattgatcacaaccccatgcagcctgttatcttctattataaaatcggtcacagtgctgttaaaacggacctctcccccaaggcggatgatttcctctctcatccctttgacaatgccgcttaaaacatcggtgcctatatggggtttatttacatagagaatagaagggtctgccccgaattccacgaaaagctccaataccttccggttcctcataagaggatcttttacaagagtattcagctttccgtcggaaaaggtgcctgctcctccctctccaaactgcacattgcaatcaggccttaacattccgcccttccagaataagtccacagcctccatgcgcttttccacggactcaccccgttccagaagcaggggctgatacccatgccttgccagcatgatcccgcagaaaagtccggccggtccggttccgatgatcaccggcctgtcagtcatttttttcgttccaggctttggaaacacatattcctttttttccgatatcccaatatctctgctcttcgctttatgtaccacagactcttctttttcggtctccacgtcaatggagtaagtaaaatggatgtcctctttttttctggcatcaacagactgttttattatttgaatggaacggatatcctttaccggaatttttaatgcttttgccgcctttgcccataaggcttcttgggtatgatccacaggcagctttaattgattaattcttatcattgttttcctcatttttcttgtttctgacctcggtcagatgcctctgtggcatcttccctgggccacactgcgcccatgttctttaggcaaaacccgccccggtttatggggcatatgtccgcaggacattcctcttcccgcgcaagtacctgccagtatgccgcaagaccatgcccactgaaggttatagcctccgcaaatgccgtcaacatcaaggatttctcctgccaggtaaagccccttaataagttttgattccatggtatccggatccacttccccggtatcaacgccaccgctgcacacctgggcctgatcaaaggaattggcggcaatgatctctgtttccagtttctttaagacagaagccagcttttttatctgggcaggcctgatatctttgacaatgccattgcttcccacatcggcttcctttaacaggatcctagccagcttatgatttaatacgccgtttaaaaattcctctgccggccggcagctgaaacgctttacccgttcctcaagaaactgccgggtatggttaaaatccatggaagggaggaaatccagctccgctgtcaccggccggccggcatccagtcctctggcagcaaagcggctgatctggaagaccggaatgccggaaattccgtaatccgtaagctgaagctctccccggtcggctgccactgtttttccatctattttaagggtcacgcaggcctctgtcctgactccggccatctgcttgtaccatttttccctgcacctaagctgtaccagggcaggcagtggttttacgatggtgtggccaagagcctttgccagctcataaccgcttccatccgagcctgttttaggagccgccatagagcctgcggctaaaataacggcatctgcccgcttctttcccaaggaagtcacaagggacaaatccttccttatttcctctacctgacagtctgtaactatggaaacccctaagtggtccaattcaaagagaagagcttccagaacggaggcagcctgtccggaatttggataaacatatccgttcctgtcagtaaggacaagaccaagatcccggaaaaattccagagtctgttccacagtgatattttccagcaccctttttataaattccggccggcctccacggtaagctccgtcagggatcatcagattggttaaattgcattttccatttcccgtggaaagaagtttttttcccggcttggctgtatgttctaaaacggtaacagaagcgccctgtctggccgcctggatcgccgctgtcagaccggaagctcctgctcctacgatgattacctgttgtttcataaaatcctcctgtatcctcagacagacctattgtatccagtttgtccctttatttcaagtgtttctttagcttgtataggattccagataattaaatacctcaatcatggaagaaaaccatataccttccatcaattttccccgttcttcctcagggaaatcggtgatgggcatatgggtataaagacagatggttgttttatcctggtagaggacgagaagatatccgtcctctgaaacaagataatatttttccttacccgttgcatttaccggctcggcctgttcctcttcctggtttattacgatctgcgcttccgtcacagtttctgtttctatggtcgccccaggcagggcttcctcaggccttacgctgtcctttgtaatggcaaacccgatccccaggcagatggcagatgccgctacgaacaaaagaaagcagaacatatacttcttcatgagatgatacctccttcaagtaagtatagtatctgccttcttcctgggttttaatcacaaaagatggaattttcttgcaatgcgcaccagcttcttccctcccggcacgcttaaaagctccgattcgtccacacagcgcagttttaaaaggagaatcccataaaccaccacagccactgctatggcggaaagtacaccaaacacattgcgctttaaggtcaaatgcaccaggaaataggtgccgtaagcagccgctcccatgaccccggaagccaggattggaagaataaatgttttcttcatttcctgcctgtaatttaaaaatcttcgtatcgcagccccgtttaaaatacacatggtaaacgcaaacaggatgttggaatacaccacgctgtagatccccatcttaaatccaaaaagcatgacacacagaattatcacgtggaggatcagggaaatgaccgcatttcttaagggaacctgcatccggttgattccctggagcactccgttggtcactgtggaaagagagaaaaataccactgccgaggatccgtatatcatcatcttaataagggctgagttgtcatttctgctgaacaacagattgcagatgggccctgccagaacagtaaggcccaccgtagccggtatggcaatgagcatggaaaaacggatcaccatggagaccttgctttttaactgccccctctgcccttctgccattgccctggaaagagaggggatgagggcggaggaaagggaattggcaattgccaccggaatgttaaaaagaagctggtacttccctgtaacgccccagttggaagcgatctccgaagctcccattcccatggccgtcataccgttcccataaatgctgttgtcgataaccgtgctgatgttatatgccacactgcttaatactatgggaaagactgtcatgaaaagggcgccggaaagctccccataggattcccggcgtcttgtcctgtcccttcttgcctgcttttttacgatcggcaaatagctgaataaaataaacaggagaaacagcagggcagccacagcccctgcccctgttccaatggtccctcccgccgctccaagggcaaaggagtattctgtggacccatgaaccagattggacttaatccctgcctgaaacagccttgaggccgcatagacgctgatgaccgcattgacgatctgctccagcacctgggatatggctgtgggaagcatggttccgattccctggaaatagccgcggaacaccccaagataggcgatcacccagatggtaggagccagggtttttaaggcatagaaggtataaggcatttttaagaaacggctggcaaatatatctgctccaaaccagagcacagcggctcccagccctcctgccacggttccgtaaaacagggcaacctttaacaccctgacggagttgcggtattcctttctggccagcctggtggcaatcatcttggacaccgccgtaggcaggctgtaggaggatatgatcagaagaagggaataaatcgtaaatgcagagctgtaataaccgtttccttcattccccaaaatatctgcaagaggaatacggtaaaacatgccaatgacccggacgatgatccctgccaccgcaaggataacgccctggatcaggaaattggaggctcccttctttgttggttttctgcttgtcctattcttttccatataatttcacattgggagaatcctgtgcggaaataatgcacacccaggtttttccctggttcaggataatctcgttattctccatgtcgtaataatgtgttgggccgaactctccttccttagtccactttatggggatggaacggccttccgtcacgtaacagccataagagtcatcctgtacgttgatgtttagatactctgtcgttgcataatgggcggaagggcagtactgcaggatgatgttcttaaccttgatctgtccttcatctcccttgtggggggccccatactggtaccggtagtaaagcccgtcatcctcgtgatattcaaaccagggcttgttgagcacataacccggataaaccttataagcatcgctgacactgtttgctccttcaagagtcaccttacggccgtcttttgcaaagcggtagtggccgtggtaggacgtatcataggattccgtgtaaccaagctgcaggatggctttgcttaaccgctctccgctggtataggcgttatggggggatttccggtccttggtacgaaaataggccaccgtgccgatggcatccagcccattgatgttatccacattggccagataaggctttgcaaaggtgctttgaccgtagtgggcataaatagcatcaaattcacgggcaaaatatgtatagtaggtgcggcagcttctaacggaaccgatccggtccagatcatcgtaattttccatgatagccatgtagcggttcattcccccttctgccggcgcttcataaaccacccctgcccggttgattccatattggggaagagcctctttgtcattgctcatcatgactgccaccggcctccggttcccgatggcagtgctgaccatctccccggtaagatagcttcgtatcttcccgtccttttcggtgcgctcttcaaaggtatagtattcaccggaattcgcctccggcccatcggccgcttctgtggtgctgctgatcttgatttcttttgtttccccagccccggaggtttccacagattgttccgagacccatacctcctcatattttttactgcagccgaataaaaaaacggcagaaacaatgataccggcgaaccctaaccatacccttttcatcatctcgtatatcctcccaggcttaagatttcctcctgcttcttttccatgatcaaacgctcttcgtcttccatgtgatcatagccgcacagatgaagcatgctgtgagcgactaaaaaagcaagttcccttatttgggaatgaccgtatttttctgcctgttcttctatcttatctacagatattacaatatctcccagcaaaagttctcctgattccgggtgaaagcagtcatctcccgtctcttccagacgctcaaaatcagaaggtctttcataatcaaccatcggaaaggaaaggacatccgttgggctgtctatattccggtattcctgattgatctggcggatatcttcgttgccggtaatgagtacattgacctcagcttcataagggcagttttcataatccagcgaatcctccaccacccttttaataatatcttcatatgggatgtccagctttttttccgcctcatattcaatattaatcgtcataacgtgcctttctgccgccaatggcttttgcctttcgttcagccggctttttctttgattcataatcatcataagcctgtacaatcttctgtaccagaggatgacgaactacgtcgctgctggtcaaatggcagaaaccaatgtcatcaattctctttaatatgcggattgccatgtcaagtcctgacgcggctccggaaggcaggtccttttgcgtctggtcgcctgttacgatcacctttgatccaaagccgattctggtgaggaacatcttcatctgagccggtgtggtgttctgggcttcatcaaggataatataggcattgtcaagggtacggcctctcatgtaagccagaggagctacctcaatcaagcctttttctgcgttgtgaagatagctctccgctcccatgatctgataaagggcgtcatataagggccttaagtaaggatctattttactttgcaaatctcctggaagaaagcccagcttttcacctgcctctatggcaggcctggtcaggatgatccggtttacctccccgtttttaaaagcctggatggccattgccatggcaaggtaggtcttgcctgttccggcaggcccgatgccgaacacgaccattttttttctgatctgatccacatactgcttttgcccaagggtcttgggctttaccggctttccggtgatggtcctgcagataatgtccttgtcgatttccaggatctggctgtcgttttcagaaaatgacagagagagggcataatctacattttgctctgtaatggcattcccacgcttggaaagctcaatcaggttactaaatacgctttttgctttctggaccatctgttccggtcctatgatcttaagggccccatcccgtccgatcatggtaacatgaagggtccgttctattttctttaagtaactgtcaaactgtccgcaaacatttttctcgtgttcagctgggatgtctatgattgtctcaattacgctcatttgaatgatttgtctcctccggttcctctgttctttgtatcttcagcgcctccggcctgccaacaggctcctcggtcacaaaatctatggcaacctggcataaagattcattatctagtattttaacatgattttccagaatttgtacccctttttccaataaattttttttgtacctttcgttcatatcctcagccagctgttttttctcttcctctgtgtaagggcgctcgtaggatatgtattctctccctgttattttaccaacataaatggggagatagaaattctgaaataaatgaagctgctcttcttccatggtctgtctccatgaagttccttctggtctgggccttatgagaagaaaggataaatcgaaagccttcatataatatcctttcctgacctttcctgtctccacgtccactttccgaaaaaggggcatttgtcttgtgaattgatattccgttctggccgttatatctccatcagagcgcacatagtgggtgttgatcacctcttcactgtctccgataatgggaagaatgccgctgaccagaacctgcccctgttctattgtatcgcctatggagaccattggaacgccgctgcgcacgatcatggaggtgatcactccgtctttttctgccacaatgtcacagggagtttcatcctttacaggaatttccgacagcacttcattttcttttattttaaccaaaaggcgtgttcctgatacccttgccgacacccaggttatttcaggaaacttgcttcggaaggattcttccagaatgtcacaatcaattttggattttctcatgccatatcggatttcttctgattcacagaattttaaaagggtgtcataggtatacatcctgttgccttcaaattcaatatcccagatgaacagggaaagagaataaagaatcagaaaaaagctcataaacccggcagcatacagcttccgctttttgttcctgtataaaaaaaaggaagtccaaacttttttaaaatcctaagtctgaccttcgatttacggacgagaggctttattttccgaaacccttgtacagtcataaaaagccgataggaatgcccggcatttatgacttcccataattcaatttcatgtacgctgcacatatttagaaaacgctcaggggaaaagccggtcatttctatggaaagataaccgaataaataatgattcagccatgcaagcactatattacacctccagtttcccttattattcaaattccagggattttatataaccgttgattttcatctcctcattggtgtaatactcaatcatcagcctgcttccgcagatgaccacacggcagtttttggcctgaagtttgatggaacagtctgtatacaggataatgctacggtagttttctattacaacgctatgacgtcccagaaaagatacgagcacttctcccaaaaccacatccttcggaagctttaaggcggaagctgctttttcctttgattcctcaaacataatcccttttctgcccctctctttttatttctgcaagcaatgagccgggcgcaggaattttccattcctgcatctggcgaatgctgtaagaggccaaaaacccattagcttgctttagggtttttggcccctttatactatatgcaattcagatgcggaaaattctaaggccttaaaagtcgaaaaaacccctggtcacgataaaacgggaccagggattcatcttttaactattagttatatttacgttttcttgcagcttcagactttttcttacgtcttacgcttggtttttcgtaatgttctcttttacgaatttcctgctggatacctgcttttgcacagtttcttttgaatctgcgtaaagcactatctaaggtctcgttgtctttaacgataacatttgacatagctcacacctaacctccctccagttgtgtacttgtgcataatacaactgtttgggtattttatagcactgatatgattatagcataattttgccatacgtcaagaaaaattttcattattttacatatcagttcagctgctctgcaacaacttccccaactttttcaaggcatgcatccacacctgccggattttttccgcctgcctgagccatattgggacgtccgccgcctccgccgccaaccaaggaagcaatggctttaatcaggttgcctgcatgggcccccttcttctgggcttcttccgtaacagctgccatcaagttcaccttatcatcctgaatggaggcgattacaatgactccgtcacctaatttatctttcagctgatcccccagattgcggagcccgttcatatccacatcaaggacttttgtggcaaggacttttactcccttaacctcttttacctgatccataacatttccaagggagtcctttgcaagcctgctctttaatttttcattttcagaatgcagggactttatctcttctaagagggattcaatttttgctgtcagagctgaaggcgttgtcttggcagcttttgccgcctcatgaagctctttttcagtctcctgataataaagcatcagaccgtctcctgtcaaggcttcaattctcctgacaccggctgcaatgccggtttcggacaggatcttaaaagaaccgataactcccgtattgttaatatgggtaccgccgcaaagctctgtggagaaatctcccatttttactacgcggaccgtatctccgtatttttccccaaacagtgccatagcaccggatttttttgcttcctctaatgtcatgatttccgtttttacaggaagggattccttgatcttctcatttacaagagtttccacctgatggatctcctcggtcgtcatggctgagaaatgggtgaagtcgaaacgcagcttgtccccgtcaacaaaggaaccggcctgctccacatggctgcccagaaccgatcttaaggctttctggagaagatgagtggcgctgtggtttttccccgtattctgacggttttcttcacagacctttaaagtagccacatcgccggtctggagcataccttttaccattttgcctacatggccgacctttccgccctgtaaatggatggaatcttccaccttgaattcgcctttatccgttacgatacagcctacatcgccctgttgaccgcccattgtgccataaaacacagtctgctctgtcacaatggttcccgtttcaccatcagtaagagcttctactatgtctgtctctgaggtgaggacaaggatcttagattcgcaggtcagcttatcataaccaatgaactccgttgttatggacggatcaatggactgataaacggtgacgtcagcgcccatataattggtggtctttctggcgtttcttgcggtttctctctgcttttgcatggcagccttaaagccttcttcatccactccgaatttcttctcttccagaatctccaaggtcagatcaagtgggaacccgtaggtatcatataatttaaaagcattctcaccggaaaggattgtttcattcttttttatcatttcctcttccagttccccaagaatggcaagaccctggtcaatggtcttattgaacttgtcttcttcctgggtcagaacctttaaaatcatggctttcttttcttccagctccggatatccgtccttggacagctgaatcacggtggtggataagtctgcaagaaactttccttcaatgcctaaaagccttccgtggcgggcagctcttcttaagaggcggcggagaacgtagccccttccttcattggaaggcatgataccgtcagagatcataaaggtacaggaacggatatggtcggtgatcagccgaagggatacatccacatccgcatcctttttatactctgtacgggccagtgcggcaacccggtttaaaagagctttaatagtatccacatcaaagatggaatccacatcctggaccactacggccagacgttccaatcccatgcctgtatcaatgtttttctgctttaattcttcatagtttccatggccgtcattttcgaactgtgtgaatacgttattccacacttccatatagcggtcgcagtcacagccaacggtacaatccgattttccgcagccatacttttctcccctgtcgtaataaatctcagaacagggaccgcaggggcctgcaccgtgctcccagaaattatctgcctttccaaagcggaaaatgcgttcaggggcaatgccgattttcttattccagatttcgaaggcttcatcatcttccagatatacggatggatacagcctgtccgggtcaagtccgaccacatcggtcaaaaactcccatgaccagtgaatggcctcatccttaaaatagtccccaaaggaaaagtttcccagcatctcaaagaaggtgccatggcgggctgtcttgcctacgttctcaatatcccctgtccggatacacttctgacaggtagtcacccttcttcttggcggaatttcctggccagtgaaatatggcttaaggggagccatgcccgagttgatcaacaacaagctgttatcattatgcggaaccagggaaaagcttttcatagccagatgtcccttgctttcaaaaaattcaaggaacattctcctcagttcattcacaccgtagttcttcacgttactgtcctccgtttactattttgtctctttcgtcacgctgccgttattcccggcatctttatgatctctgtatttcttgccgcacacgattccgccccatgcaaggaacaggaaaaacaggaatttgattgcggtccccaggaaacttgcgaatattgctgtcatatttttttcctcccgaaaattcatatagtatcactcattttactatcctatcataaggaattttatttatcaagatgttgcaatggaattttttttgctgcaggcattcctttgcctggttcactgcctgcagaaaataaaaaagtacggcaaataccgtactttctactgtccctctcccgaggataggacatccatatattccgctaccagatcataggcccttgcccttgtggactctgtgagagaagcggtgtattcaagctcttccaggcttccgccgctgtaccttttagcggcctcctctgcctttgcgtccctgcctttgatccattcctgctgcgagatttcaaggtcttttctgtcttcctcgttaagcccttctgaaatagccgcataaatggtattctgctccctgttccaaagctttagctctttatctaccagggccttcatggaataggtattggaatctcctgattcctcccgcatcttttttatctgggcatctaaatccagcaaacgcttctgatagtaggcggctccctcggaagaagcagcagagttaagcgtcctgttttttgtatccggatttatgggagacatgacggtttcttcgatggaagcctcttcggaactctcggtctcctgaggaacaggctctgtctgatcggaaaccggagcgcttttcatcctcagtcctgcttccgccggctgagacttattttccggagcggtttcagcctttgcggcagcagccggaccgtttttcctaagcattggttcctctcccgctgcaggagcttcctggggaactgctatatccgcggaaaacaattccggtgctccgccgtaggcgtttgcttcctcaggagcatcctggatttcagaacttgaaaatccggtgattcccgcagaatccccagcattttccttgcttttcacaaaactggaggtggcaagggttatgagaatcccaatgaccagaatgcttccgatcacaatccaaattcctctatttttattcatgaaatatcatcctaacctgtttgatgaatttaacatatcacaaataaaaaagaaagaaaataggagtctgcaattagtaagactttgtaagagatatgtaagtttttggtattttccaagatatggaggctcatatcccttcatctaccagcagatcctccccatctgcagcgcttgtggccagcatgtcgcaccgttcgttctgaggatggccggcatgtccctttacccaatgaaaagtcacctgatggggttccatggcttttaacagcctttcccacagatcaatgttctttacaggaccgcttttgcccctcttccagttgttttttatccagttttcgatccaatgctggttaaacgcgtccgtcacatatttggaatcagagtatagttccacctggcagggcctggtaagagcttccagacccgcaatggctgccatgagttccatacggttattggtggtttttacatatcctgctgacatggttttttcgtggagctgccctttggaatccgtaaactgcaaaaccgcgccatagcctccaggcccgtcaggatttcctcttgcagctccgtcggtaaataatagtactttcgtcactttctgttgttctccttatctatcccatttatcacataatgaattaatctgatctgcaaatttggcaagatctttattggccccgccttcattatgacggataacctgcaaaagcctttcgccggcagcaaaaagccttccatagactcccaccggcctttttgagatctccggtgccttggctactgcaacgccctctgtttcattcagccatctgccagcggaaaggtcataaacagatcctgagtgaggagcttttaccttatatccgtaatccttttcaaggagctgctcaaaggagttgcaaaccagatcatcgccgtggaccagaaatacttgttgcggtttttcttcaaatgcgttcaaccaggcaatcagtccttccctatctgcgtgggcactcatcccatccatctgttctatatgggcctccacctgaatggtttcgccaaacagccttacttcgctgctgccctcgatcaggcttcttcccaaggtccctatggactggtacccggtaaaaacgatggtgcatgaccgtttccataaattatgctttaagtgatgccggatacggccggcatcgcacatgcctgccgctgatatgatcacttttggttttgaattaaaattaatgttcttggactcttcgctggtaaccgacagtttaaggcctggaaaggatatggggttaatgcctttcattaccagttcctttgtctcttcatcatagcagtctaccaggttatctttgaaaacctgagttgcttccaccgccagagggctgtcgacataaacctcaaacccgtcatgcccggtaatcagcttttccgccttgatacggcggaacatataaaggagttcctgggtccttcccactgcaaaagcaggtatcaccacgtttccgcctctgtccagggtctcctggacaatgcctgcaagaatggaaacatggtccgggatcacaccgtgaagcctgtcgccgtaggtgcattccatgaccgcataatccgcttcctttatgtactgaggatcgcggatcaggggtttattcttgttgccgatatcaccggaaaatacgatttttctggaaacttttccttctgtgatccagatttcaatagaggcggaaccaagaagatggcctacgtctgtaaaacggattgtaaagccctcttccagttccaccttttcattgtaattgtaggaatgaaacagctccaatacgcccatggcatcattgatcccatacaggggttcttcttccgggaggcctgcccgtctggcttttctgtttttccattcggtttcagcctcctgaatgtgagcgctgtccttcagcataatgccgcaaaggtcggcagttgcaacggtagaaatcacccgaccccgaaagcctcttgcataaataaaaggaagcatccctgcatgatcgatgtgggcatgggtcagaagaacgtaatcgatttccgcaaagctgaccggcagatccacattttcaaatttatcaatcccctgctccataccgcagtccacaaggattttaaaaccggcagcttccaaataatgacagctcccggttacctcgcgggctgcgccgatgaacattaatttcatataagccctccttttgtacctgttttttctattataccattaatttagataataatgcaaatcataccgccattactatcattaataattttttggagggtgtcctgaagttttatttgacagtcttccgtaagctgggagactttagcctgaatgccgtcttccacgatctgttcaatggattttccgaaaatattggtattccatattccttcttcgctttctcttgcattttctttgatataggcgatcaagtcctctgcctgctgttcgcttcccacaataggagcgatctccgtctggatatgagccttgatgagattgatggaaggagcctctgcacgcatttttacgccgtatttatttccgtgcttgatcacttccggttcatccaggatgatctcggaccgttccggagtcacaattccataccctttaaagcgtacctgactcatggcctgattgaccttttcatattctgccttcatttttgcaagctcgcttaaggtctgcattaactgatattctccctcaatgggaagccctacgtaatcgcttaaaatctgataataataactgtcatccacatccattgcaacggaaacgcttccatccgccatattcatgttctgaaccttgatggaccggacactgtccgctgatccgtcaaataattcggaggatacgtccttcatatgggagacttttttaaccatatcctttgcggcctggatgacctgggctttcagccaatgggttgcagggaggatttcaagccattttggaatgaagaaatccatctctgtcacggggaattcctttaacacccgttccaggatgttgttcacgtcatcttttttcagctgttcacagttaatgggcatgaccgtcaccccatatttctgactgatatcctttgagagggctgtggtttcatcagaatatggcttggaagaattaagcaggatgataaacggttttcccagatttttcagttcctgaacggtgcgttcttccgctgctatgtagttgggacgcttcaattccccgatggaaccgtctgtagtgatgaccacaccaatggtggaatggtcattgatgacctttctggttccgatttccgctgcttttgtaaaaggaatctcataatcaaaccagggagtttttacaagccgctcttcgtcgttttcaatgtggccggcagcaccgtctaccataaagccgacgcagtcgattaagcggacttttgtttcgatctcatctcccaggcggataacggcagcttcctttgggatgaattttggttccgtggtcatgatggtttttcctgccgcgctctggggcagttcgtcccttgtctgagttttctggtgttcatcctccatgcccggcagaaccattaattccataaaacgcttgataaaagtcgattttcctgttcttaccggccccacaactccaatgtagatttctccgttggttcgggctttgatatcattgtatacgttataattgtccataaagattcccccttctgtgctgttatactatatgcatgggagaaaggattattcccttttctttttcacccagcttcctggatagatccatatgattcctgctcccttctgctattctgtttagaccggcaataatggaaaaaagtaaggatggcaaagccgtttttacacttcttttgccatcctttataatcttgttgtgctgatttttatggttctcttttcatgctttttgcatttgaaatggaacttacctgattcggttaaactcattggaaaaaggcttcatcacttctacagctgcccgttctatggccaatcctccggtataacgctccataaatatctcaaatccggctgtatcctcaggatccggcattacctggtttccgctctcgccggaaaatacccggttttcaagataatgctccaatgtttctccttcttccctgtgaatcatataggaagccagcagagcaattccccaggctcccccttccccggctgtgtccataacggaaaccggcacattcatcgccgctgccatcacgctttgccccacgccttttgtcttaaacaggcctccgtgaccaaacaccaggtccagttttaccccctccttcttaaagaggatatccatccctgtttttaatgcacctaaagaggtaaacagatggaccctgataaaattagccaggttaaaccggctgtcaggcatgcgtacaaacaagggccttccttcgtcaaatccggtgatatgctctcccgctaagtaaccgtaggataaaagtccaccgcagtccttatctcctgtcaatgccagattatataacacggaaaacacatatccggtctccgccttataacccatttcatccagaaattctccaaataaagatatccatgcgtttaaatctgaagtacagttgttgcaatgtaccattgccaccagatcaccggcaggggtggtgactaagtcaatttcctcataaacatgggccagctccttttccagtacgatcatggaaaatacactggtgcctgcggacacattgccggtccttggtctcacactgttggtggccgccattcctgttcccgcatcaccttccggagggcaaaggggaacgccgtactttagctgaccggaaggatccagaagtccggcgccttccggagacaggacgccggcattttcccctgctgataatacctttggaagtatatcatgaagcttccaggaatatcccgtgtctgcagccaaccggtcaaactgatccagcatacggctgttaaaatccctggtttggatatctatgggaaacatcccggaggcatctcctactcccaaaactttttgtcccgtaagaagccagtgaacataaccggataaagtcgtcataaaacccatatccttcacatggtcctcctggttcagcatggactgatacaaatgggcaatgctccatctctgaggaatgggataagcaaaaatttccgtcagcctggcagaggcctctccggttatggtattacgccaggtccggaagggagcaagctgcctgccatacttgtcaaacaccagatacccatgcatcatgccgctgattccaagagaacctaataccttcagctccacaccgtatgttttctttacatcctctgccagattcctgtagcagccggtaaggccccttttcacttcctccaggctgtacgtccagacccggtcctcaaaccggttttcccagtcatagcctccgcaagcaagaggaatatgattttccccgatgagcacagccttgattctggtagaaccaagttcaatccccaaagaagctcttccgttttcaatggcttccctgattgcagaaacatccaaatccataagccgtcctcccccttacacagtaaacaacggccagaccatgtcaagagcttctttgactgccgtatactttttaaatttttttaaataaattttgtgtttttccatatccggcattacctttttctccacatgaaccatattccgggccgcctcttcataatctgtgaatcttccggcagccacagtggcagccatagcgcagcccaatgctcccagttcctttgctttgatggtttcaatgggaatccccagaacatccgcaaacatctggacccataccggggaattcacaactccgcctgccatacggatggcttccggtttttcccttactttaagaagcttatcgatgtgggttttatgggaatagacgaccccttcataaacagccctgatgatgtgggcatttttatgatatgtagtcagccccaccagacttcccttgcccaagggatgggcattggagctgtataggaagggcaggaaatatacgtcgcactcttccggcagaacagactgaacctgacggcttaaaaagtcatatttactttccccatcctgcctcccgctgaaatcaatcaggttatccatacaccattctaagtttcccgccgaggtggcactgcactcttccaggagataataccctggtatggcaaaaagggaattcatggcaaccggcccatggagcaccggtttttccgcaataaattcattgatgctccaggtacctgcgatggtgcaaagccgttccggctttgtaatatccattgcaatggcacaggcatcaatatcaaacatcccgcctgctacaggtgttccttccaaaaggccggttctttcggcagcttcacaagtcagcttcccgcacagatcatgggaatacttaaggggagccagcttttcatacacttctccgatcccatagctttccaatagttctctgtcaaataccttatcccgcacattgagaagaccggagccggatatatcggtggcttcacaataggcttcccctgtgagccggaaacggatatagtctttcaccgaaaacacccacaggatcttgtcataaacgtctctgttatgatccttcagccatgcaagcagggctgcctgctgacagggcatcagctgctggcatatccgctcatatatatggtcaaaaactccgttcttataccatttttccgtatattcccaggcccttgtatcagtggatacgattcccctgtaagccgggcgtccatccctgccccaggcgtaaaggcccttgccgtgcccgcacacggatactccaatgatatcagcaggattaataccggcatgttccactgcccccttcatgcagataaggttattctcccacaatagatccatatcccgctccgtataaccggatttaggagtttctatcggcgtaccggccgaaaaagcactgatctgatttcccttaaggtcaaataaagcggcctttgtcatagtacctccgttatccagacccattacatattgtttcatctcacacctcccctgcgtaagcagcatccagatgcccttttaaaaaccggttgttttttttaagggtatcacggtaatccccttcacctgtataccagaattccgctacgtaccggttgatccctaactgtctggtcttttggatgactttttcaaaatccacctgaccctccccatagggaatctcccggaactttcctggcagagtttcctttagatgaaccgaacagatatggctgcgcccgcattctaaatcccggtatatatcatcggtcccattccatatatttcccacatcagggtatacggaaagatagggcatttttgtctgatccacgtaatacatggctttttcaaccgtattcataaactcgttttccatggtttcaaatccaacggtgactccatgggcagaggcatactccatgcacagcattaaattactcagaaattctttcctggtttctgctgaggatgtctccccataataacaatcatacccctgtgcctgtatgatgcgtattcccatttttacagcaaaatccacacactttttaaaaagctccacagctgcttctgccgccccctcaagaaggctgcccagcgggaactttcgctgggcactaaagcagatggattcaaaccggatgccagtatccagcgaaagggattgaagcatcagaatctttgcatcgccaaaattaagccgattgattttttcttcggtttcatcgatactcatttcaataaagtcataccctgtatcttttgctgctttcagcttttcttcaaaggataactctcccggcatgcttttttcatacaagcctaaccgataaactccatgactagtcataatccttcccttaccttactaagcggataatcacaatccgctttgctgcctggttaaaatttaatagctaccttaaagtcgccgtacttgcctccggcatattcaaacgccttttcccattcttcaatggggaatgtgtttctgataacaccgtctgtctttaaattgccgtttgttatgttttcaatgacaaagggatagcaataaggacttaagtgggcacctgcaatatccaattccttccggtcgccgatgatggaccagtccacagtggcaggttctgaaaatacgctgaattctacgaaacgtcccagctttctgatcatggaaagtccctgcaccacactggaaggatggccggtggcctcgatatagatatcgcatccataaccttctgttaaatccatgaccgttttcactgcatccgttttccctggattcagcaccagatcggcaccaaattcttttgctttctgcagcctgtcatccatcatatcaaggacgatcagtttggccgggtttttcatgcgggcataagtgaccatcccaagtcccagagttccggcccctgagattaccacaacatcctcacagccgatttctccccggtccacacaatgctttgagcaggcataaggttcgattaaaagcgcatcctcaaagggcatatcttttgggactttatgtattacagaaccttttggatatctcacatactcagccatgccgccgttattggtgtgctggaaaccgaaaatatcatgaggctggcacatccagtagcggccggatttacaaaacttacattccccgcagggcttgatctggtcggcagtcacacggtcaccgatctgaaattctttcacattatcccccagttcaacaatttcgcctaaaaactcgtgtcctggaataaagggcggttttacccatgaaggctggacctcatctccccagaacatggctgctccatggctgcattttaaatctcctgcacagattccgcagccttcagtcttgatgacaatgtcatccggaccacattccggtgttggataagccggctcaaaacggtagtcatctttggaatacgcaacaagtgccttcattgttttcggaatactcatcttaaaaatcctccattcttttttatacccggattcggtccccggtgtttacatcaaacagatgggtcttttctgaattgaattttaaatagacctcatcgcctttctcgtaatacacatcatctgttgtggtaatgcttaacaggttgtcacccacccgaaggctgattctgcgctcatcacccatattttcatatacggcaacaggtaccggtgtgctggtggccggatcatgggaaatcagaacatccacaggacggacacccagagtcaccttcagatcttccctgaccacaggcttataacggtcaggcaccagaacctttaatccgctgttttcaaatgcaaaataataccgttccccttccgttttgataaccgacggaattaaattcatgggcggctctccgataaatccggctacgaattcattggacggatcatcgtatacttccaggggagtccccatttgctgaagtttcccctccttcataataacaatcttatctgccatggacatggcttcgatctgatcatgggtcacaataatggtcgtgcatttgatctcatgatgcatcctttttatttcctgcctgagcatctgcctcattttcccatccagatggcttaaaggctcatcaagaagcaggagccccggccgccggataatagccctggcaatattgacccgttgcttctggccgcctgacaaagcagcaggtttcatctgcaataaatcttctaccttaagcaaaggggcgaccctgccgatctcttttctgatttcctcttccgtctttttctttgcccgcatattaaaagcaagattctcatatacggtcagaggcggatacagggcataatcctcaaaggccaggccgattccacggtccttgggaagcagatgattgatacgtgtttttccgatgtatacatctccggatgtgatctcctccagacctgccagcatccttaaggtagtggattttccgcatcccgaaggtcccaggatcccaatgaattccccgtcctcacatcgaaacgaaagatcattgacggcatacccgtttgccgctttttttttctctttattgtcatactgcttatagatatttttaagtaccagctccgccatatcattgacctccgtttagactctttgcttcatatttctgtcttccggctcttgtaatcaattcctttgaggaatggtcgaaatagagagcatttgccatattgaattttaaataaacctcctggtcaatagaagccctggtatcattgggggcaaccacctccaatttattttcaccggcaagaaccgtcatgatgaccttatttccaatgggttcattggcataaaccgaggctctgatccaggtactgtcctgtttttcaaagcgaaaggcgatgtcactgccccggatacccacatcaatctgctccccatccagggaggctatacggtcaatcacatctggtgtcacctccaggacagagtcttgttcaaaggcagcaatcagcccctgatttccactgagcttaaaagcgcctgaaaaaatgttgatctcaggttctccgaacagtcttgcgacaaactcgttgcggggaagataatacatttcaacggcacttcctatctgcacgatcctcccctcatgaaccacggcgatccggtctgccaaggacatggcttccatgtaatcgtgagtcacatagatggttgtggtattaaaattgctttgcatttcttttaactcccgccgcataaaatgacggagctttgcatccaaatgggctaagggttcatccataaggaatacattgggttttctcaccaatccccgtccgatggccacacgctgccgctgcccattggaaagctgactgggctttcgctccagtaaatggttgatcctcatcatcacagtgacccggtccacctcagatcggataaaatcctcgctttgcttataaagcctgcttctcatgggggaagcgatattatcataaacacttaaatggggataaagggcataattctcaaataccatggaaacgttccggttcatgggttccacgtggtttacgatctttccatctatcttcaccagcccctcctgggggaattcaattcctgcgatcaccttgagcaaggaagttttacctgctccggccggaccaaacagtacaaagaattcattgtctttcacagtcaggctgaccccgtccaccgctgtcttagatccgtatttttttgtaacattaatcagttctatttctgccaatcccctgtcctccttatcctttaacagcgccgaagctgagtcctcttaccaaatgcttctgaatgaacagacaggcgatgatctccggcagaacggctacggtggccgccactgccacctgcccgtaatgtacggtttcagatgaaatataccgaagggatgtgatggtaagggtttggatcttaaacccgctgagaatcagcggaaatgtaaaactgttccatgcaaagataaaggccagaagccctgaggcaaccagtcccggtttgatcagaggcagaagggtctttaaaaacacttcataccagcagtacccgtctaaggaagcggcctgctccacctccacgctgatatcctcaaaatacccccgtaccacccagatgagaagaggcatggtgatcagctggtaaacccaaatcaaaccaaaatatgtatcatacagcccgatcttttgaaagatcaggaaaatcggcagaatcaccatgatctccggcgcaaacttaaacgataaaatctgaaatgcaatatcatcctttttccggaagtcataccgggccagtgcatatgccgcaggcacacctgccactaccgtaagcagcactgcccctccggaaacaataatattttgaaaaaaagcccggacataatccgttcccagcagaaccgcctgataattggcaagtgttggccggaagataaagactgtattatacatttccgtatcgctcttaaacgtacagatcagcatccagataagagggaacagggcatacagggcgtacagggcaagtcccagattgcgtccggtttccctggccccttctttcagcctgtttctttgtttcgcggtttcaatggaatgctccataactgtcctcctttctgaatcaatatccctgggcctgctttgccattttacgctgcctgtttacaagaaaactggctgtaacattgacaatcacccaaagggtcagcaaatagggaagtgcataccctaacttctggaattgaaatcctgtaatatagcctgtcagtgaaatgttcataagcgtatttcccggtccgcccttagtcagggcaaatataatgccgaattcctgcagtgccgccatcaatcggaataaaagagcgatgtacataaacggcttaagcatgggaaaggtcagtgttttaaagataaaccacgaactggccccatccacttcggctgcttcaaagggggatttcggcagagactgaagccctgccaaaaccagtaacagcacgaagggggtatttacccaggtatctatcagcaccgcagtgaacatggccgtttcctgggatgctgcccacttaaatccatacacaccaaacaggtttaaaaacttttccagcacgcccaccgaattggaagtcatcagctgccagatgagcactgcaatggccggagccaccatcagcggaaaagtgaataccacctttaaaacccttgtaaatccggtatccttccgaagcaggatcgcgattacggaccccaggatcatctgagttcccgttgcaaagaatccatacttgatggtaacccaaagggaatggtaaaaatcagggtcctgatacacccgaatccagttgcgcaaaaagatgaacttaaaatttggatttttaaatgagtaatttgtcagcgataaaaatatcgctatggcaaatggaatcataatcccgatcaggatcaggagtccgggagcgatgatatagtacggccgtctgcgtatatgagccggaatttcattataattgatttccttcggtgttttttgtgccaaacctgcccctcctttataataattcactcagcttattcatagtcagagatgacaatgtcttctactaccttatcctgcttctcttttaaactgtccatgccttcctgaacagtggcataattccccgctaccagttcctgcagtgtggttgcccacaaagtggtcgtctcaaagaaataaggctgaggggtaaaacggatggtcgttgatccgatggtcttttcaaacgtatcaatatacccgtcgtgactctccatcttttttaagaattccggagaattgattacggaagtacgcgccgggtcaagagcatttttctcagtcaccgcataaagagcaaaatccttgctggtaaaatacatcataaaataccatgctgcatctgcattctttgtatctgcattcattgccatggaccatgtccagaagtttgaattgggggtgtttccttcctttgctaaaggcatcactgtccatgccagattgccggcctctgcagaagccccttcccagtcctgatgaatcccggtgttatccgcttcaaacatcatggcagccttgccggctcctaagtctgcgccgcactcataccacgtatatctggaccatgacggagatccgcctctcttgatcatgtccacccagaattcggtcattgccactgcctccggtgaattcaccttagataccagtcggtcatcctcaatggcaaaatcctgggctccaaaatttgcaaatgtgctcatgtaccctggatgaatggttccccagtctcttgccccacggacggtcattgcataagaatccggtccgttccagccctgaagcttgtcacaggcaaccagcagctcgtcataggtcttaggaacctctattcccgcctgctgaaaggctctcttgttatatgcaaggctgtaaatttcaatggccagcggaagacccagctgggcaccggaacctactgcatgtcccgggactccgtcccattgaagcgcggatactgcacttggatataaatctgcaaaatcatatccaggggccaccttatccggcgcgtttaaaaactcattcaaatcatatacataacctgccgccgaataatcccacagctggtaagcacctgacatgaataaatccggttcaccggtcctgctggcaagggctgtggataccttatcaaaataattggcctccggcgtaatagagtgttctaccttgataccggtcaattcctcaaattcaggaatcttggttacaatagcctcagccacactgtgctgtaccatatttaccttcagcgtggtaccggcatacttcttccagtcaaaatccccttctcctgtctgggactgggcttccgatcctgctgctgaagtttcctgcgccgttcctgcctcctgagttgtagccgataccttagccgtacccgatccggagctgctgcaccccatcagggcccccgccgtcataatgcctgccataccaaaggatatccacctttttatattgctttttttcacgtttgtcaaacctcctctttttttatatgtaaatattacacgaatatggtttttaatgaaatgaataattatactataattgacaatttattttgtagtttaattaacaatctttctgacgagggcggttatgattttttttagaagaatcttacgaaaatataaaaaatgttattatcgccggaacacaaaaaaagggcgcctgttcttaaaacggcgtccttcccattctatacacggttcttaaactctttgcaagtcatccctacgatctctttaaacaccttgctgaaataatagggacttccaaagccaacctgctctgcaatttcatatattttcagattggatttaagaatcagcctttttgacatttcaatccggtaatttgtcagatacacactgaaattgattccggtttcctgcttaaaaataaacgacaagtagctgctgctgatattcaccgctgccgccgcattgtccaaagtaatattctgagaatagttctcttcaataaaaccaatgcactccctgatcagcccgctgtatgggctcttcctgttatgtaaaaagtcccagattgccatgtacacatccattacatacatctgaacatgattcatatgggagattgcataaagattgtgatactcaaactttaccgggttcagtccgggaatatccctggtatcgtaattttcgatcagggatttggagattgaaagcaggtcaataaatacctcggtcaccattcggtaatccccgccttctttcagcttacggaaaatggaattcatatactcggccaacggatccttgtcctccttttccatcagctcttttactttcctggcactgacccggatatactctcctctggacggattcaacagctcatcgtatgtccaaacactgccgttatgaaaaaagcccttcagccgtgcgctttccgcctcctgaaacatctgagggaaacgttcttttgttccggctctgctgattccaaggttgatgtccgcattaaaatactgaactgtattcttaataattgatgctcccctgtcctccatcagctcttttggatattcattccgttcatcatgatatatgaccccaaaacaaagaagatcctttaaaattacatacctggcaatgctgtggcaaaaaaatttggaaaccagattcatgactgtttcaatcagcatgctgactgacccgtccggcagggaattaatgctgcagtggcctatcataatcatgtaagatgcttcacaaaacatacggtcagaatatggataatcagaaacagtctcctgtacaccggagagattcagcttaagcagctgctcatccaaatatttttcttccatcttctttacagaatgtcccttgcggtatgatgcttccgattcgcctgataaattgaccagagatgacagcaggctgtccggtgaaatctctgactttaaaatatacttttccgcccccatttccatggcccgccgtgcaaaattaaaatcatcatgattcgtaaatataacggactggatgtccgaatattttgtttttgccctctcaattaaatccagaccgttcatcccctgcattttgatatcagtcatcagaatgtcaatcggttcacgctccatgatctccagagcttcttctgcactgctggcctctgccgcaatctcatacccgtaggatttccagtccagggtcatcttaagtcccatccggaccaaaaattcatcatccacaatcaatacccgtttcatattattttcccgcttccctaaagacaaacaaacatggtacaataagttgatttagtgactagtataccataaaatccggaggtatgtgatgcatattaagaaaatttcaacaaaaatttttataggagtattcgttctctctacatttttcctagttttgtctttgacctttgtcaattatactttttatagggaactgaaaaagaacgagatacagaacaacctgcttgcaagcaacaaaatccgttcacaatttgatttaatcataaatctgatccaggccacctccacctacctgtatgaaaatgaagagatccaggaatacttatccggccagaatccccaatcagccggcaaaataagtgaaaacctaaataacattctggagatgcagccttttatttctcatatctccctgatgagacccgacgcagccatattaagtacagactccggaacagaatcagctttgctgtcagcgtattatggagattatatggaaaaaaagcaggttatcagcgcggaaggacaatggttcaccacgcattttcagaatcccgccagggattctgccgataaaaaggtcatctcctttatcaagcccctcatgaaccgggaacaacaattccttggactcctgatcatggatttaaattacaattacatacaggaaatgttcatgctcagcaccattttatccgatgaaaagacgcttgtcatcaattccgacggcgagattctgtttaatttcccctattacacttcctacgagccggttctcagacagtatcctcagctgttggatacctcgaccagctatagtctggagggaaaggtctttaatctggacagtaccattgtatccaatcccatcaagattgcggactggagtattatacgcatcattcagacccagcatttgatcagcaatacgaaaaaaataacctattatgccgttatcattattatcatttcctgtattaccagtcttatttacggcctttggctcacaggcaagatcacccgccctatcaaggtcctcagtgatgcctgcaataagataaagggcggtgatttttctctccgtgtgcaaatggattccagggatgaggtgggaaatctgggcgtcacttttaatatgatgctggacaagctgaacagttattttattaatgaacttcaggagcagaaacgcaaatcatcccttgaatttaaaatcctacagtcccagatcaacccccattttttatataacaccctggattccattcgatggctggccactatgcagaatatcacaaatgtggctgaaatgaccagcgaccttaccaatcttttaaaatacaatttaaagcaggatacaacctctgccctgctaaaggatgaaatcgaaagcattcgtcgctatatcggtatacagaaataccgttatggaaactactttgaggtagaatatcagattgccgaagacacgctggaatgtattatcattccattttgcatccagcctctgattgaaaattctattatacatggttttgatgatatggataagaactatagaattcggatcgaaagctatgaagaaagtgataaattatatgtgaaaatcacagacaacggagccggcatggaggactctgtcctggaagaaatcaattcctctaaggttaaaagcaacaaattcaatcagattggcattaaaaatattaaggaaagaatccagatgcagtatggcaaggaatatggattgctttatgtaagtgaacctgacgcagggacagtggttacgatcatctttcccaataataagcgggataccataccggattatgaaagtgaaaataaataaaaagagaaaaatcccctcaacttaccgtatgctttatacgtgaaattgaggggatcttaaatccggcaaaaaaatattgtatgattattcgcttagatatgctttctttacggagtcattgttcattaattctttggcatcaccgcttaaaacaatggcgcccgtttccagaacataagcgcggtttgcaatggacaaagcctttttggcgttctgctccaccaataaaaccgtggttcctgatttgttgatttcctgtataatatcgaaaatctcgttcacataaatcggagaaagccccattgacggctcatccaggacgatcacctttggatggctcatcagtgcccggcccatggccagcatctgctgctcacctccgcttaaggttcctgcaggctggttctttctctccaagagtctggggaaacgcttgtagatcatttgtaaggtttcttctatctcgtctttatcccgccttgtgtaagcgccaagctttaaattttcataaacggtcagagcggcaaaaacacgccgtccttccggaacatgagccattcccatacctacaattttgtcgccccgtatttttgtaatatcgtggccgtcaaactgtattctgccggaggctgcctttataagaccggttatggtatgaagagtcgtagtctttcctgcgccgttagcgccgattaaggctacgatctccccttcctttacttcaaaggaaatatccttaagcgccttgatgacgccataatatacttctaagttgtttacttcaagtattgccatgccttaagcctccttattctcccagatatgccttgatgacttccggatcattgagcacatccgccgtttttccctgggtgaggacctggccgaaatttaatacggtcagcctttcacaaatgccggagacaagcttcatatcgtgttcaatcaacaggatggtcatatcaaaattgtcccgtacaaagcgaatggtgtccataagctctgaggtttcgttgggattcatgccggccgccggctcgtcaagaagcaaaagcttagggcctgttgcaagggcgcgggcgatctccagcttcctctgctttccgtatggaaggttggaagcaaggatatccttttctccatcaagaccaaatacctttaaaagttctatggcccgctcatccatctctttttccactttaaagtactttggaaggcggagtatccctgtgaccgtgccatagggataactgttgtgaaggccggtcttaacgttatcaagaacggtcaattccttaaacagacggatattctgaaaggtccttgcaattccggccctgttgatatccactgttttttttcctgtaatattctcatcacctaaaaaaatggtgcctgcattcggtttatacacaccggttaaaaggttaaagattgtggttttaccggctccgttagggccaatgagaccataaagctgccctttttcaatggtgatgctgaaattatctacggcacgcaggccgccaaatgaaattccaagattcttgatttccagtaaagccatggttataccctctccttttctgccctgttcttatggaaataccgcttcctgaaatcaatcagcttcggactccagttgaaaatcatcataacgatcaggataatggcgtaaatcagcatccggtaagtatttaaacctctcaaaagctccggaagcaaagtcaggatgaccgcagagatcatggaaccgcggatatttccgattccgccgagaactacgaatacaaggatcataatggactggttataaccaaagttcttctgcgttgcagtaagcgcagaaaggttatgggaatacaggacaccggccacgcctgccagagaggcggaaatagtaaaagccattagtttgtatttcgtgatattgatgccaatggattctgccgcaatgcggttatcgcgcactgacatgatggcacgtcccgacctggaatgaatcaaattaagaacaatcacaagggtgatcagaataaggatcacaccaatgacaaaggtagagtttttaggcgttccggtaattccctgagcaccgtttaagattacctttccatcttttgccatattaagagccattgcatttttcatggaaaaatgaagtcctgccccatcttttccaatataaatcacgtttaccacgttttttataatttccccgaatgccagggttacaatggctaaataatcgccgcgaagccttaaaaccggaattccgaccacaatacctgccagtgcagccgcggctgctccgatcaaaatggcaaaaaagaaacggattcctgtgtttggaatggcttccagcatggcaatggaaaacagggaactggaaaatgcgcccacacacatgaagcctgcatgtcccaggctcaattctccaaggatgcctacggtcaagtttaaggatattgccatgatggtatatatgcagagaggcaccaaaaggcctttcatcaggctgcttacctggccggcattcaccaaaagctgtacaattataaatgcagcgatcacaatgccgtaagttatcagattgcttcttaaggtcttactcagacgaaatttattcttcacacttttttccatatcatccacctatactttctcgttgatcttcttacccaggattccagtaggctttacaagaagaacaacaataagaactgcaaatacgatggcatcggaaagctgggaagaaatataagccttgcttaagttttcaatgacgcccaataaaagtccgccgataaacgctccgggaatagacccgatcccgccaaatacggcggctacgaatgccttaattcctggcatggagccggtatagggagtaagagtgggataagcggaacaaagaagcgcacctgccacagccgccaaagaggagccaattgcaaacgtaagggcaatggttccatccacattgattcccatgagctgggcagcacccttatcttccgatacagcaagcatggcctgtcctgctcttgtctttttgatgaatgcagtcagaccgatcataatgataacacagctgataattgtgacaatggtctcaccggaaatggtgagctttccctgggaaagcttaagtgccggaactgtcacgacagaagtaaaggattttggattggaaccaaaaacgagcagtgcgatgttttggagaaggtagctcacaccgattgccgtgatcagaactgcaagaggacttgccatgcgcagaggacggtaagcaacaccctcaatgacgacgccaagtactgtgcataagatcactgcaaggagtatgccggcaaccgggccaaggcccattgtgctgacaactgtgaacaccacgtatcctccgatcataattacatcgccatgagcaaagttaagcatcttggcaatgccatataccatggtataccccagggcaatgatcgcataaacgctgcccaggcttagaccattaataaaataggatatgaaactcatcatatcatcgcacctcattcgttgtttattttaaaagaagagggtcgtcctctggacgaccctccattgggtcatttaccaaatgaatgaaattcagtaattacattgcagtgtaaacaccgtttacgatcttaacagccttaggagccttatccggttctccgtctttagaccacttcatgttctcgcctgttaagccgttcatggaaatttctgtcatagatatctttaaagcgtcacagattgctgaagcatccatgtctgctgtgatccctgccttttcagcagcagctttgatggcgtaaaccgcatcataaccgtcggcagcaaactggttcggtatctcaccgtatttctctttgaatgttgcaacaaacttctgtgtcagctcatcctgtgcatcagcggcaaacggtgtcagaagcattacattttcagccagtgcagtgtcaaagttttctacggtcaaaattccgtcaagtccgtcacagccaaaaaactggggctcatatcccatctgctttgcctgagcaaggatcagggcagcctgggaatagtaaattggaaggaatacaagctcagcgcctgaatcctgagccttctgaagctgtacggagaagttggtattgttatctgcggtaaatgcctcatcagacacaatttcaattccctgattagctgcttcggaaaggaatttatcatggataccagatgaataaacatcggagctgtcataaataacggcaaccttggtagccagcttgttctcgccgatgtactgtgcggaagctgctccctggtttggatcagagaagcatacacggaactggttgtcgaattttgcacagtccactgcagaaccggaaggagtgagctggaacatgttgtcgttactggactccgcacctactgcaatacatggagcggaggtaacggtgccgactaacatctgcataccccagtcctttaaggtattgtaagcattaactgccttttccgtatcgtgttcatcatcctggaagttgtactcgatctgagcgccgcctattccgccgcctgcgttgatctcgtcaatggccagttctgcaccgcgcataacagcctgtccataaatggctgctccgccggtaatcggtccgatacctccgattttaaaggagccttctccagaggcctttgctgcttctgtagtctctcctgatgccgcgtttgactctgcggcagtggtggtttctgaagttttgccgcccccgcatgcagttaaagacgctgccaaagcgactgccatgccaagactcagtaacttcttcatagattttttcataatccattcctcctcatacaacgtttatatatacagttctgtgacatgatttacttgataaaggcaggaaatttaaagccgtaaccaagtagataccggttcgattcccaaaagacagatcgaacttcgtcgactatacatagtctttataataaaatggctttataaaaatgtcaactgcttttatttcaattatgaaaaaatcaactgaattcttaactatttatcccagggcagatcagagctttcaatggttttatcccttaacattaaatccttcacagcctctgatgcgggtttgccgtcaaagaggaccgcatttacctgttccacaatgggcatggaaatgccgtattttaccgacagggccagggctgctttggcagagtaaataccttccaccaccatctttacttcctttgtggcctcttccatggtttttccctggccaatgaggattcctgctctccggttcctgctgtgcatacttgcacaggtcacgatcaaatccccgatcccggacaaaccgcaaaaggtctggaatttgccgcccatagccgttcccagcctggatatttccgcaatgcctcttgtgatcagggccgcctttgtattgtcaccgtagcccaatccatcggcaattccggcagcaagggcgatgacatttttaagggaagctcccagctcgatcccctggatatcagggcttgtataaacccggaaaacttcgctcataaaaataccctggatgtattcagctgtctttctggtgcgggcacctgccacacaggtggtgggcaggcctttgctcacctcttccgcatggctgggaccggaaaggactgccacatctgccattggaagctcctcttccagaatttcagaaagggtcataagagaggactcttcgattccttttgccacattaacaactacctggccatatctgcaaaacggattcatctttcttgcagtggaacggacgtatacggaaggaacggcagttaccagaagatcccgtcctgtcatggcttcttctaaatcttccgtaaaaatcatgtccccaggcagctccagatccggaagagtatgatgcctgtgggtcgatttcatctccgaaatttcctcgggaagagccgaccagacagtcacttcatgcccattattatatagaagggctgccagcgcaattccccagctccctgatccgatcactccgattttagccattttcctcacctcattttatttttttccagatccaatggaaattttattctctctgccacggacaagccgtccgatatttgcccggtggcgccagaacgcttgaccgcttatcagggctgccactatgtagaattccggcaacgttcttgggtcaagaccataagcccccgtctttccaaagaggaacagccatacaaataaaattgttgcgaccaccagagagcccagagaaacatatcttgtaacagcaacgatcaaaacaaatgcagccaggcataagagtgtcagtcttaaatcaacagctacgatcagcccggcagtggccgcaattccctttcctcccttgaaatttaagtagaacgggtaattatgccccagaataacgccaaagcccatatacaatatcaggagataaatcatctccggctgggagcggaacaggacccgcatcagcaggcagggcagcaatgactttaaaaaatcaccgaaaaagacgactgctccggcctttgcccccatgacccttaaagcgttggtggttccggaattaccgcttccgtaattgcggatatcgattttatggacctttccgtaaaaatagccggactgtatgagcccgaataaataaccggcaataagacagatcattcgctccatactactgttcctttccgcttctttctctataaataaacttaagggaggttcccttgaaaccgaatgcttccctgatcttattctctaagtatctggtataggaaaagtgagtcagttccttatcatttacaaagatcacaaaggtcgggggctttacagcaacctgggtgatataataaagccttaaccgcttgcctttgtcagacgggggctgctgaagggcaacggcttctgtcatgatttcatttaaaacgcccgtagccacccggagtgtctggttttcccgaaccatatcgatcacctcaaacagcttactcatcctcagtccggtttttgctgaaataaatacgaactctgcataaggcataaaagacagggtgtttttaatcttgttggtatattcatagatggtcttgtcattcttttcaatggcatcccatttgttgaccgcaaccacaatgccctttccccgctcatgggcaatgcctgcaatttttgcatcctgctcggtcacgccttcctcagcgtcaatgaccactaccaccacatcggccctttcaacagccgttacggtcctgatgatgctgtaacgttccagttcctctttgatcttgcttttccgtctcaggccggctgtatcaatgaacacatattccgtatcattgtgaacgatctccgtatccaccgcatctctggtagtgcctgcaatgtcggagacaatgacccggttttctcccagaagctgatttataatagaagatttgcccacgtttggctttcccacaattgcaattctcggcctgtcatcctcttcctcttctgtatctgcagtgccaaaatgctttgccacctcatcaaggagatctccaaggcccagcctggaagctgcagataccggaaccggatcgccgattcccaggttatagaactcatacacatcatttccaaacttctggaagctgtcaaccttattgaccgcaaggacgacgggctttttagatttccgaagtatatccgctaccttggaatccgcatccaccagcccctgacgaacatccacgataaaaatgatgacatctgcggtggcaatggcaatctccgcctgttcccgcatctgggacaggatgatgtcgctgctgtccggctcaatacctcctgtatcaatcagggtaaaattcatattcaaccaggtacagtccgcatagatcctgtccctggtaacgcctggtgtatcctttacaatagaaatggtatcaccggccaaaacattaaacaacgtagactttcccacattggggcggcctacgatggcaactactggtttactcataaatatttcctttctcctctttgcccatgcttttggggcataaaggtatacccgaagggtatttctccctctcgcccatgttttccgggcagggcccaccctaccctatggggtgtaaagggatacccgctggggtgcttaactcataaccttcataagaagctccattctcttctaccggcccgagaacagcctgtacaaaatcctgaccgcttgattttacaatatctacctgtacttgtaaagcattttgtacatcctgccgtgtcagatcgtcaagaaatacctcttcaccgcttcgaaacatacattccggaagcaataaccggctgccaatcaccttatccttaagctgcccgatcagatcctgtccggtgatcaagcctgccaccgtgatctgttcaccgaaaaaggcattggtaatgggataaatgtgaatgatccgtccgggaaacttttcctggatcagttttgcatgactttcaatatagggggcggcaagtctgcctgttgcaattgaaatctcttcggatttgctgtcaccctccatattttccagggcagccctgacttcttcttccaaaagccggagcatacccactccgttttccagctggatatacccgtcataacgcccttcttccggaagggacagtccggccaggatataaagctcatcgctggcgtgaatgaaatggctgccatgggtcttatacagctttttctgccaccgttctatgatttccagtatctcttttgcatcttcattggtaaagggctgtaaaggatataagccatcccggtattttgacattcccacaggaaccgctgatacgctttccatgtatggaaggaagtttgacaaatcctctatggtcctctccagttcctttccgtcattgacacccttgcacagcacgatctgtccgttcatggggatctccgcctcatacagcctttggatcttgtccagggccttgcctgcaaaccggttgtgaagcatctcacatcttaaggaaggattggtggtgtgaacggaaatgttaataggcgccagtttaaatttaatgatgcggtcgatgtcatgatcgctcatattagtcagcgtcacgtagtttccctgtaaaaaggaaagcctggaatcgtcatccttaaaatacagggtctctctcattccaggggcatctggtcgataaagcagaaaatgcatttgttccggcaggatttatattcgctcatcaacccattttcaaaggtgattcccagatcctcgaattgattctctatttccagctcccattcttccccgtttttcttttttacagtcatgaaaatggactcgctgttaatataatactcataatcaaaaatatcttccagctcatgaccatctatggacaggaccgcatctcctggctccagttccagctgttctgcaatagagccgggatcgactgctttaataatatgtcctcttttgctcatcttaatttttacctttctgcaactatcccatatatcataacaagattgtcactctttgtaaaggaagccttttttgtttttttcctggaaaagcagcaaagactattgacgcattctgtcaatcaatggtataaaagggtgtaagatttaaaaagcaggcagtcttacggctggctgttcatttattatggaggactctttgtcatggcacatgattatgtatttaacgaccaactacctgttgctcccttaaagattgcagcgctggaaagctgccgggaactggccggaaaagtaaacgatcacatcgtaggtttccgcagaaatgatatccaggagctcatacgccggaaagccgatcttcactaccgcgggtatgatgtggactcctaccttctcaaatgcgaatgcccgcgttttggaagcggagaagcaaaaggcattatcaaagaatctgtccggggaacggatgtctttgtaatggcagatgtcaccaatcacagcataacctattcggtcaatggttataccaaccacatgtcacctgataatcattttcaggatttaaaaaggattatcggcgcatgcagcgcaacggcccacagggtaaatgtcattatgccgtttttatatgagagccgccagcacaaaagaacaaaaagggagtccctggactgcgccatggctttggaagaactggtttttatgggagtcagcaacctcatcacctttgacgcccatgatccccgtgttcaaaatgctattcctttaagcggctttgacaatttcatgcctacctaccagtttgtcaaggcagtgttaaagcagtatccggacttaaggatcgataaggagcatttaatggtcatcagcccggatgaaggcgctatggaccgtgctgtgtacctggcaaacaacttaagcgtggatatgggtatgttctataagagacgggactactccaaagtggtggacggacgcaaccctatcgttgcccacgagttcttaggttcctccgtagaaggcaaaacagtgctgattgtagacgatatgatctcttccggagagagcatgctggatactgcaaaggaattaaaagatcgaaaggcggacaaggtaatcgtatgctgtaccttcggcctcttcaccaacggactgaccaaattcgacgagtattacaaccgcggctacattgactgtgtcgttaccaccaatctaaaccaccgtcccaaggaattactggaaagagaatggtatgtggaggcggacatcagtaaatacattgcggcaattgtgaattccttaaatcatgacgtgcctataagcagagccctttcttctacagaaaagatacagaatttattaaaaaaatatgttttagtttaaaacaggtaaagaacaataatgaatggcttaaataccgcggtatttaagccattttataattagaccggcctggtcatcaaactttttatttctccgcaagccctaaaaatgccgccagattccctctctcatttccagtcgtccgatgggaaaataaatagtctgaattacaatgggtacagatatccgtgacctggatattttcctgcttcactcctgtttccaacaggataatctcatttgccctccaaagatcaagcaaatacttctcatcttccttttcagctaatatcccttcccaatgtcttttatcaaatcccttcctaaactcctgggcgacctcgcttcctacctcatagcaatccctgcagatgctggggccaatgcaggcgatcacctcctctgcccttgttccaaaagcttctctcattttctctagggtgattttccccatacggttcacagtccctctccagccggaatggctgagcccaatggcccgatggacaggatccagaaaataaaggggcacacaatccgcataaaaagtcaccagggtaattcccgggacattggtgattaatccatccacattttcataatcccgttcctttatgatccctttccctgcgtcctcttccgtcaccagccggacattggtggtatgagtctgataggacaggaccatccgttccacatcaactcccagggcctttcccattctgctatagttttccaggacatgggcccggttatctcccctggtaaatgtaaaattcatggtagcaaactttccctgactgactcctcccagcttcgttgaaaaaccctgctttacaagccctgttttttctaaaatcggaaaagataaataaggtaccttttctactgttttataatccattctcatttcctgaactcttcgtttccacatatctttcatcacacctttgtttaaaatgcgtccttaatcagccggatttcctctcccaggatcgccaccacatcaaaccggcagggaatatcctctcccagacggtgtcggtataaatacccttttgcagcattcctgatttttctctgtttcaaaagatgaacagcttccgccggatcacccttctccagagtccgccggtattttacttccacaaagactaattctatcccattctttgcgataatatcaatctcacccaggcggtcccgataattccgttccaatattacatatccatttttttccaaatatgcggcagccgcatcctcaaactcatttccgacttcccgatgatttttcaaatacatccccatttttcgtcaatccacaaagttctttataaagctgcgcctgtgaatggggcatgggccaatttcctttaatgcctttatatgggcagccgtcccataccctttgtgcttggcaaaaccatattccggaaacaatttgtcatactcttccatcatatgatccctggtaacttttgctaaaatgcttgcagcagcaatggacacacttttggaatctcccttaataatgggcacctgggaagcagcaatgcccggaatcgtaactgcatcgtttaaaaaaacttccggctctgcatccaatttgcttatagcctgcctcatagcctcataggttgcctgcaggatatttatttcgtcaatcctgtccgctcccacgacacccactgcaaaagaggaggctttttccataatctctgtaaacagagcttctctccgtttctcagacagcttttttgaatcattcaaataaaggatctcacagtcccttggaaggatcgccgcacctgccaccaccggtcctgccagcggccccctgccagcttcatctatgccgcaaaccagtacatgatctccataccggcgttcaaactctttcattttctccaggcgttcccgttcttcctgaagcttttcttctgttaattttctcatttttgtctccagttctcatttcacgattgaaaaaacagggtcttgctctttttcaaaaagcaaaaccctattgctctattccgcaggacgctccagagtcatccgccccagccttccgttcctgaaatcatcaatcagaaggttggaagccttcattaaatccagctccccgccctttgcaagacaggctctgacccgagccacctgttttaatccctccagcacatcttctgattttatgccatatttctcagaaagaacatggggatattctcttgtcaggaaacggatgagttccatggcaagttcatccttattcagtatctcgtcattgacggatccaatgagagcgagcttaagtcctacctgctggtcctcaaatttcggccacaggattccgggagtatcaaggagctccaggcttttattcagcctgatccattggtttccttttgtcacgcctggcctgtttcctgttttcgcacacgcttttcctgcaaaggagttgataaaggtagattttcccacgttggggattcctaccaccattgcccgcaccgggcggtttaaaatccctcttctgcggtcacgctcaattttctctttgcaagcctcctgaacaacaccattgatctgcttaagacctgctccgctttttgaattcaccttaacaacgtggcagccttttgcttcaaaataagactcccatgcgctgttgcagcgttcatctgcaagatcggatttattaagcagaaccatgcgcgcctttccggctcctaattcatcaatatcaggattccggctgcttaaagggactcttgcatccaccagctctattatcagatcaattaatttaatatcttctttcatagcccttttggctttggtcatatgacctggataccattgtatattcataacattcctctacttcgaacgaattagttccatttttacaaacggcagaatccggaaccatacctttccctggatctggcctctgcttacatttccgatattggcaaagcggctgtcttcactgctgtctctgttgtcacccagcaggaaatattcatcatctccaagcttgaccggcttttccgcaagccctgccagggaaatgcggccaggacctgcaggttccttaagcttttcgccgtcaatatagatttcatcgttttttatctgcacggtttccccaggcaggccgatgacccgctttacgttcattttctggtcttctctttgaaatactaccacatcaaaccggttgggatggctaaaatcatagaccagacggtccattaaaaccacatcatccgaggtaagaagagggagcatggaatgacctgcaatcgggatctgtgttccataagcatagaccagaaaccatgcaaatgcgatcaccacaacaatgtcaacgatccagttgactacatgccggagcttattattatcttcactgtgatagaaatccatgtatgaaacaccccatctataagtaactcatgtcaagaaagggacaatttgcattgtccccctcatctgatccggaattatttaactgattctttaaccttggcggccttaccaactctgtctcttaagtaatacagttttgctcttcttactttaccctttcttacaacttcaatgttgtctacggaaggggaatgtaatggccaggtcttctcaacaccaatgccgttagaattctttcttacggtaaatgtctctctggcgccgccattctgtcttttaataacggttccttcgaaaatctgaattctttcgcgggttccctctttgatcttgttgtataccttaacggtatcgccaacgcagaactgcggaactgcctgctttaactgtgctgcttcaatattcttaataatttcgttcattgtgtgaacctccttgatattatttgatgttcttaatactttgcaattggaatccgtaacagaggaacatcgccttttcatcacaacgttatatattttatcataaaggaccttagaatgcaagtcctttctttcctaatcattcccgtttttccatctcattttcaagtttttttaaatattctgcctctttttttgacaggctggcatcagccagaaggtccggcctgcgttccagggtccgttttatggactgttctctccgccagatatcaatattcttatgatgcccggataaaaggatttcaggaacccgaagtcccctgtactcttccggtctggtgtactggggatattccagaagattatcatggaaggattcaaattcagcagaagtctcgttgtttaagacgccgggaatcagtctggaaatgcagtcgatcatgaccatggccggaagctcgcctcctgtgagtacatagtcaccaatggaaagataatccgtggcaatcagctccaaagctctctcatcgataccttcataatgtccgcataggaaaacaaggtcctcttcctttgccagttcctccgcgatcttctgattaaaaacccttccctggggagtcatataaatggccctgggcttttttccgatcttctcacacaagtcatcatatgcctcacagatgggcatgggctgcatgaccattccggctcctccgccataaggataatcatccacatgacggtgcttgtccgtggaatattcccggatatcaatggcttcaatggataagaggcccttttccgccgctctcccgatgatgctggtatgaaggccgttttgaaccatctcaggaaacagggttaatatgtgataattcattgtttatttccactcctctatcttaatccagaagcccgtccatgatgtgaaccgtaacaagaccttctgtcaaatccacattcagcacacattccctgattgccggaagcaggacttccttcccttctgtcgtttttacttcgtaaacgtcattggctccggtcttaatcacatcggtcaggattccaaagtccttcccatcctcggtgactacacgaagcccgatcagatcaacaatgaaattttcatccggtcccagctctacggcctgatccctggtaataagcaggtcttttcccttgtatttttcaatgtcatcaatggaatcatatcctttaaatttaaggattaccatattcttaaaaaattttacgccctggatttccagttccatacgttcccgtccggcatccaggatcacattctttaagtctttaaaacggtttacatcatctgtagttggataaacctttacttctcctctcaccccatgggtggatgaaattacgccaactcttaacaaattctccatctgtctctccataatatttgcggctgaataccaaaaggaccgtcgtcccgacaggccggcggtcttttccggttactggatatctacagtaacctttttgtcttctttggaagctgctgcttttacaacagagcggatggcctttgcgatcctgccctgcttgccgattaccttacccatatcggaaggtgctaccgtaagttcaaggatgatttcatcctcttttacggtttcagtaacagcaacctgatccggattatcaaccagtgctcttgcaattacttctactaattccttcatatgcttcacctctcactactggataccggcgatctttaaaagcttgcttacaacttcggttggctgagcacctgctgttaaccacttcttagcgttctcctcattaaacttgattacgcttggttctgtggtaggatcatagtaaccaacctcttcgatgaatctgccatctcttggagatctggaatctgcaactacaattctatagaaaggagcctttttctgacccattctttttaatctcatttttactgccattgtgaaattcacctccttaaatcttgaattctaaaactaatttatagcgaatgcagaaaactgccttgctaactttaaaattaaaacggtaatttcagtttgcccaataatccgccgtgacgttttccgccgcccatcatgccgggaagctgcttcatcatttttttcatctggtcaaactgctttacaatgcggtttacctcgctgatgtccacgccggcaccttttgcaacacgctgttttctggaagcgttcttcataagctccggattcaaccgttctttgctggtcatggaaagaataatagcttccacccgatccatggctttttcatcaaaatccatgtccttcatctgtcccatgcctggcatcatgccaaggatacttgccatgccgcccattttctttatctggttcatctggtctaagaaatcgttgtaatcaaattctgccttgcgaagcttttgggataattcctttgctttttcttcgtcaacctgaagttccgctttttcaataagtgaaagaatgtctcccataccaaggattctggaagccatacggtccggataaaactgttctaaatccgaaagcttttcccccatgcccacataaaggaccggctttccggtcactgcacggatggaaagtgccgcaccgcctcttgtatcgccgtccagcttggtaataataacgccgtcaatgccgatcttatcattaaacattcctgccacattgaccgcatcctggcctgtcatggcatctacaaccagaatggtctgatgaacctccaccgtctctttgatttcaatcagctcgttcatcatgtcttcatcaatatgaagacggcctgccgtatccagaatgattacattctggtcattttttgccgcataagccacagcggcctttgcaatatctgccggtttatggttttctcccatggagaacacgggaaccccctgcttttcaccgttgatctgcagctgcttgatggcagccggacggtaaacgtcacaggcaacgagaagaggctttctgccctttgccttaagttttccggcaatcttggcagtggtggtggttttaccggcaccctgaaggccggccatcaggatgatggtcatatcgctggcaggctttaactgaatctcagtagtctcagaacccatcagctttatcagctcttcatttacgatctttattaccatctgtccgggagtcaggctgttctggacatcctgtccaatggcccgctcctgtacagcacttataaactgtttaacaaccttaaagcttacgtcggcttccagtaaagccatcttcacttctttaagggctgcttttacatcggcttcagacaagcgtcctttgccacgtaagctcttaaatacattctgtaatttatcggataagctctcaaaagccatataacgccctcctaatgagcttccagctcgatgatttcgcccgatatctcctcgatgcgacggatcagattcatgtctgacctgtcggcaaactcttttgtcaaactctgaatctctctggccagtttttttgtctgttcaaacttttttaccagatgaagcttttcttcataaccttccaggatcttatcacaccgtttaatgaggtcatgaacaccctgacggctgattccctgttcttctgcgatctcacttaaagaaaggtcatagaaaaccacatcttcataaatatgcctttgatgctccgttaaaagagcgccgtagaaatcatatagtaagccttgtcttgcaatcctttccatatcatcacctgggatatcatacaatacttttcataaggtgtcaagtgttttttctttacacccttgctttatttaaatcatttttttctctttgaagaggtttttcaagaaactttttcatgaaataataaagtttcctgctatggatgatgtagctgccatgatcctctcccggaaggatccggagacagctgccttttatctttgaggcaaggtaattggtatgtgattcacggaccatatctctttctcctgccagcagaagtaccggaacgcagatggtctccaggtcttttcctgtgatcctgggttctttcagcatcatcagaagctttggatcatgatttaaagtttccatgacagtaaataatttgagccagtaccattttaagccctggggataagcattcgcgccgcagagcaccagctttgaaaagagctccgggtatcggacggcagcaaggatcccgatgatcccgccgtcgctgaagccgcagaaataaggccttttaaggttcattattttgacaaattccgccacatcctcagccatctcatcatagcccagagtctttacccgggaactttttccatgatccctggaatccagggcgtaaacggtataatctttgcgtaaaagctccgctgtttcatcaaagatcctgtgatcctccccgtttccatgaacaaggacaatggccggaccggagcctgacacttcataaaacaatttgattccatttacatcaatatacacggcttctccttattttggggaatgatctcgatccagtagccgtcgggatcgctgatgaaataaattcccatggccgggttttcaaagcagataatccccatttccttatgctttttatagcagctttcgtaatcatcagcctgaaatgccagatgaaattcacattctcccaggttataaggctcttttcgttctgttaaataggtcagttccagagtgaaatcactttttccatcgcctaaaaacaccagccggaaggaaccgtctgccgctgttttttccctcacaggggtaagccccagcgcatccttatagaattttaagctcttttccagatcaagtacattaaaattaaagtggttaaatgtaatcataccgccgtcactccttttctttttataccagatacgttttccattttcggattgcacatctgtctttgtctatccatcataccatactccttatgccacttgtcaactgcaaccgcgcatcttacccagggaataggaaaaaaactcattccggattctccggtattcttctttaaaggaaacacccttcgggtataccttaacacccgataaagcggggtgggcactgcccaaaaagcatgggccggaataaggaaaggcccagcctttcaaaaaaagccggaccccagtcaattcttatttcttcggcacaagcgctttcatgccgcccatatagggctgtaaagcttccggaatctttacggttccgtctgcctgtaaattgttttccaggaaagcgatcagcattcttggaggagcaactactgtattgtttaaggtgtgggcaaaatacttctttccgtcgtctcctgcaacgcggattttcagccttcttgcctgggcatcgcctaagttagaacagcttcccacttcaaaatactttttctgtcttggagaccatgcttccacatctacggatttcacctttaaatctgccagatctccggagcagcattccagggttcttacgggaatatccagagtgcggaataaatcaacggtattctgccataacttttcataccaatccatgctctcttccggcttgcagacaacgatcatttcctgcttttcaaactgatggatccggtacacccctcgttcctccaggccatgagcgcctttctccttacggaagcaggggaatagctggtcagagtctgaggaagcttgccttccggaagaatggtatcaataaattttccgatcatggaatgctcgctggtaccgatcaggtatagatcctctccttcgatcttatacatcatggcatccatttcagcaaagctcataacgccggtcaccacttcactgcggatcatgaatggcggaatacagtaggtaaatcccctgtttatcataaaatctcttgcataggaaatcacggaagaatgaagccttgcaatatcgcccattagataataaaagccgttgcctgctacctttcttgcactgtcaaggtcaatgccgtcaaagctttccataatttccgtatggtacggaatatcaaactcaggcacaacaggctcaccgtaacgctctacctctacgttctcgctgtcatccttaccgataggtacgctgggatcaatgatatttggaatggtcatcatgatctttttgattctttcttccagttcatgttctgtttcttccaacttggccagatgttcggaagcgtcagtcactttcttcttcatttcctccgcttcttccttctttccctgtcccattaaggcaccgatctgtttggaaagtttgttgcgttcagcccgtaaggcatccccttcctgctttgccgcacggttcttctcatcaagttcaacgacttcgtcaactaacggcagcttgctgtcctggaatttattcttaatattttcctttacaatttcaggattttctcttacaaactttaaatctaacatggtattcctcctggtttctcctcaatattctctgcgaaagttgtcccgcataataatctgccgttgattatactacaaaaaaagggcaaagaaaagcccctttcctaaaattccccttttctgcccgcgctttttaagcatttccctctccattctcatctcccaatgagcaaagaaaggatttcttcaaagcacactccgtttttcaccggaacatgaagctcatcggatttcaaaatgctggcctttacaaaacgggccgcttttttcactgcttctgtcaatggaatgccttttacggtctcagcagccaggatactggaaaacacatcacccgtccccggccgttcgcttcccacatgaagagaacgcaggaaatgcggctcccggcccttttccgccaccacgttggtcacgtagccaccctcccttatgcctgtgatcaccacggaatccggtcccatatcccatatctcagccgccatggaaagaagctcccggcgcttccagcccgaactccggtattctcttccggtgaggatgcaggcttccgtcagattcggtgtaacaatgtctccaaatcccaccagttccctcatgcggctgcacatccgttccgtataggtctggtaggcctttccgtgatctcccataatggggtccacgataacctttgtatccggtgtgctgaaatccctgatcatgtcaaccacaataccgatctgttcctcagagcctaagaatccgctgtaaatcccgtcaaaggataggtccagttttttccactgttccacatacaaaggcattttctttgtatagtcatcaaaaaagtaagtgggaaatccggtatggttggataaaatggaagtggggacaggacagcactggacctttaatgctgaaagaatggggagggccactgttaaagaacagcggccatatcccgataaatcattgatgacagcaatttttttctgatgtttttctggtgtcataaaagctcctaataaatttttgataacagtccggatctgaccaagccatcccgaaggggcatgtaaatgatgacggacacaatggtggaagtcacggcattaatggaggttgataaaacgttccatgccagcgccagctctgccgccggttttcccagaatcagaagcttataatagtaaccgatcaggggatcaaaaatcacattgaacaaaagacctcctgctgcggctgcaatggtccaggtcaggatatgctttttatcagtggattcctgaatcctgccgattttatgagccaaaaatccggtaatcaggccgatgcaaagcttaaggataaaggtcttcggtgcatataccacataaaccgggtcaaagagatctcctatggtcatgccgatggcgccgcctaaaccgccgtataacccgccgatcaaaagcgctcccagaacgcagaccgcattccccagatgaatggaggtggcatctcctcccggaagcgtgatcttaaattgcaggaatgtaaatactacataagacatggctgcaaacagtcctgtcagcgcaactttataaatcctgtcatttgttttactcattggtaattcctccctgctgcttttatttttttatcttagcacgcaagtggaatgatataaatatccagtttagatatattaaaccataccagtttaatcgtgggactggatacaaatcaggatcccggattcaaagtcaatggtgccttccggaccggtcagttcattgctgatgcataaactggttcctaagtcaatgtccttttcataaagaggatatttgaatccggtcagtgtgatctttttcacctctccgctcaaggggaggaaagaaatgtatttcccccataatctttcagcctgaaaggtccttcccttatcaatcactgtgatccagtttttttcatcaacaatggcggcttccacaccttttttcaggcaggcataaagaagatggagattgccgataaaatggtccatccttccgcctgtggcccccagcagaaccagcctggagcagccaagacctatggcagtattaagagccagttccgtatcggtctcatccttttccggtttatgaatctcccaggtgatcctgtccgggctgtttttgtattctgccagaacatcttctgacaccgtatcaaagtctccaacaatggcatcaggctttaaccggagtttagaaagggccgccagccctccgtctactgcgatgattttatcaaaccttctgttttccaaaaatcttccggcaaatccataatccatggtgccgccggtaaccaccaggccggtaatttccttattcttgtccatgtcttttggacataacggtatgcctgtaagacgttctttcttcacccttcatattcctcaaatatttttaagaatgcctttgtattggcggcggcatcacctttaaatacggctgaaccggcaacaaatacattggcgcctgcttcaatcagttccctcacattttcacaggtcacacctccgtccacctggatatctgtctcaagatgactttccctgcaaatctgtcttaaagccctcactttatccagtgtatatggaataaacttctgtccgccaaagcccggatttaccgtcataatcaaaaccatatccaattcaggcagaatgaagtccaggaccgataagggcgttgccggattaagagccactccggcctttagccctgcttccttgatctgattaacggtgcggtccaaatgggtacaggcttccgcatggacacagatgagatcggctcctgcttctttcatatcatttatataccttccaggttcctccaccatcatgtgaacatcaaatacccggtctgtgcagcccttaaggcttccgatcaccggcatcccaaatgaaatgctgggcacaaatgctccatccatcacatccagatggatgtactgggctcctgcttccgctacctctgttacctgctgtccaagaattttaaagtccgccgctaatatggaaggggcaagtttaagcatattaatatctccttttctcctttagttcctgatataaaagccggtaattttcatatcggctcctgtttattttgccttctttcacagcatcctttacgccgcaggtcttttctccaatgtgcacacagcccagaaaacggcagccgtcttcataaggctcaaactcaggaaaataatccttcagccggttgcattccatatcttccatgtacatggagctaaatcccggcgtatccatcaagtacgtatcccctcccatgccaaaaatctccgaatgcctggtggtgtgctttcctctctggatcttctcgctgatcgttgcagtctccatatcagcctgaggataaagaaggttggttaaggaggactttccaactccggaaggtcctgccagaaccgtggttctcccatgcaccagctccttgatttcctggattccctgattgtcataggtgctggtaaaataaacgggataaccggctgcctcatagatatctctaagagccagccttttttcattttcagttaaatcgattttgttgaaacagatttttacgggaagctcctgaacctccatcatgaccagaaaacggtccagcagatttaagttaggctccggatgggtaatggcaaacagtaccagcgcctgatccacattggctacggcagggcggaccagggcatttttcctcggcaggattcgttcgatgttccccttcttttccacgctgtccagaacggaaaattccacattatctccaaccagaggcttcacgtttttattacggaaaataccctttgccttgcattcatagatggtttcgtccccaccgtggacatagtaaaagcctgcaattcctttcaaaatttttcctgtcatatattgttccttatgattgggggaccggaataaatgtgacggagtatgaattgatcacatcgcctgtctccacattcacgatctctacggttccgctgttaacaccgtaagcaccttctatattcttaaatgatacgggaagcatctggtctcctgtcatggtaacaggtcccataagctctctgatttcgtcttttccattgaccgactgcctcagctgtatcttcaaggtaagctgtgtgctgccggagccgggcccgatgatgttctgcagggaataagatttatcaatggaagccagatatttaaccttggactgctgggctgttccgctgctgaccacaaagtccacgctggttcctgcttctacctgactgtctgccgttaaggactggctgatgacacttccccagggaactgtctcggaggcagcttctgtcactgttcccgcaaccagtcccacgtcagccagcatttccaaggccacttcatgggtctgaccggcaatattgggaacggttacagggtttacaagagccgggccggtacttacaaccagggtcacggtctccccttcctttgcctcggaggggctgtagctgatcacatatcctgttgtaacagtatcatgattcttctgctccacattgacgatcaggccgtttccttccagtgctgcttttgcagaaacgccatccattttgtcaaggccaagctttgttaagtcaatggcaacgtgttccggacccttgctgaccacaacatagacagcagagtacttatcaatgactgtgccctctgccgggtcctgagacacaatatcccctttgtcaatggtatcgtgaaatacgtaatcacttaccttcatatacagtccgccgttgtcctttaacttctgttccgcaatatccgttgccagacctacaacgctggtcattttcacctttttgtcgcttaaggtttcttccgtagaaatctctgctgttgattcggtctccttaggggaaccggaacggaataaaccgctcactttggaaaatacaattatcagcacgatcacgatgagtatggccacaacaatacctgccgctgtcagaagccgttcgattttaggattgatatcatcctcggaatcctgttttctgtttctgccgttgcccggctgctggcctgcatttttttccatgcgtcgttccggcctctgctcctgattcctgctgacattgcggctggccgccggatctgcctgtaccttacggccggaccggatctgctccagctccggttttccgatgatgaccgtctgggaatcatccacctgggaattgtactggacaaaatccccatcaggattgacaagtgctttccgtaaatcggatatgacctcatgcatgcttccataacggtattccggttttttctcggtgcactttaaaataatgttttccagtcctaccggtatgttctcattatagaaactgggcggtgttatggggtcttccaaatgggccagggcaacggtcaccgtattatctccctgaaacggaacacgtccggccaccatttcatacatggtaattcccagagaatagatatcgctcctgacatcgctgtaaccgcctcttgcctgttccggcgatatgtaatggacagagcctaccgcagtagcgcttaaggtctgggaagaggcagcccgggctataccgaaatcagctacctttacctttccatctctggcaatgatgatattctgaggcttgatatcccggtgtatgatgccctgttcgtgggcagccgcgattccctgtgcaacagaaattgccacaccgatggcttccttaacatcaaggcagcctttttttgaaatataattttttaatgtaattccttcgatcagttccataacaatataatggagggttccttcgtccactacatcataaatgtttacgatgttgggatgagaaagacaggcagccgcctgagcctccattttaaacttaccgacaaagccgctgtctgaactgaactcttcctttaatacctttatggcgacagggcggtttaatttatggcacagggccttatacacatctgacatcccgccggaaccaatctggtccagtatttcatatctgtcctgtaaaaatgtccccggtctcaagatcataagcttacctccctgccaatttcgggttcaatcaaaacaacagctatattgtccttccccccattgtcattggctactgtaattaatttttctgccttttccggcagctccagttctgagcagataatttcttccatctcagcgtcctcaagcatattgctgagtccatcggaacacatgagcacatagtctcccggctccaggctgacttcaaaaaaatcaatctccagcttatcctctgtaccaaccgctcttgttataatattctttttttcccggtaatcccggcttccccgttccagctggcctaatgacaccagctcttccacgtaggaatgatcctttgtgatctgctgcagccggttcctcaccaaatacaggcggctgtctccaacattagccacatacatggtagaatcctcaatcactgctgccaccagggtcgttcccatgccgtttaattccgtattcttcatggattcctggtaaagcattccgttgacttttaagatcccctcccgaagaagcggaacaatccccggcgaatccgcctgttttaagtggtccaccagattttcggcaatatatctggaggcaaaatccccggcctgatgaccgcccatgccgtcagcaaccaaaaaaagattgggcagtgtgcccaaaggctctgcctgggcatagacataatcctgattggccgtgcggactcttccggtatccgtcatagcgcaagccttcatcgtttcattctcacttcctctttactcctgatgtcaggcggatattagcaatccgctccgctacttgctcataatcaaatagcagctattgctgcttatcaggcagaaccaatgctccatctgatacaagtaagtcccctccccactaattaattctcttcgcatttgaagcgggggacttccctgattcggttaaaaagctttttctcaactgcccgcaggcaccgttaatatcccttcccatttctcttcttatagtaacatttattccgtttttttcaagaagatttttaaatgcctctatggctttccggtctgactgcacgtaattgcgttctttaatagggttcaccggaatcagattcacatggccgtgctggccttttaacagggctgccaaagcggaagcttcttttaaattatcgttgacaccgcttaccaggctgtattcaaaggtgagccttcgccctgttttttcaaaatacgcctgacaggcatccagcacatcctttagagggaaacggttcgccacaggcatcagggtttttctgacctcatcgtttggcgcatgaagggacaaagccagggtgatctgtaaatcctcatcagccaatcgaaggattccgggcacaatgccgcaggtagaaaccgttatgttgcgctggctgatattaagtccgttttcatctgtaagaagacggatgaactgaatcagataatcaaagttgtctaaaggttctccggaacccataacgaccacattggaaacccgttccccggtgatcttctggatccggtatatctgatcaagcatttccgacgggcttaagtttctttccaggccgtcaagggtagaggcacagaaccggcagcccatgcggcagcctacctgggatgaaatacagacggagtttccatgcttgtatttcatcaaaacgctttcaatcacattcccatcagaaagagcgaataagtattttcttgtaccatctatttttgagatcttttcctccacaacggtaagggaggtaagctctgtcagctgcagcagcttctccttcatggagttaggaagatttgtcatttcattaaaatcagccgccagtttccggtgcatccactcatagagctgctttgcacggaatggtttttctccgattgacaccaaaaaggctgtcagtttctccatatccagagattttatatctatcttatccattctacatttcctctattccgcccatgtttttgggcataaaggtatgcccgcagggcgttcctctattccgcccatgttttcgggtgtaaaggctgcctaccttttctgaaatgccgcaataaagaatccgtcacatggatggattcccggcagaagctgtatatattcctgttttgcggcggctgaagccagcttatctcccagttttcctttcagatcgatgcagtcaaagggaaaatgatcaatgaaccactgggcattttcttcattttcttttctgttaatggtacatgtgctgaaaatcagccgtcctcccggctttacataagcctggacaaccgacaatatttcccgctgaagagctgccagggattctaagtcttccggcgtcatgcggtatttgatatcaggctttcgtccaatgatcccaagcccggaacagggcagatcagcaatgacaatatccgccttatccatggaatcagggtcaagaacaagggcatcctggacctttgtcctgatatttgaaaatccgcaccgttttatattttcctggaccatgtctattttggagagggttaaatcccggacctccaccataccagtcccgtcaagcttatctgcgatatggatgctctttcctcccggcgcaccgcagacatcaatgacataatcgtcttttttcggatctgcgatttcgcccacaaaacttgagcttagatcctgaacctggataaatcccttttggaatgcctccaagccttccagataatcatatttttcaatgcaaagcacagcttctgaaattccggactcactcacttctgctccctggtttctaaggctctgcagaatttcttctttggaagcttttgcataattacagcggacaattgtctttttattctttaaaaaggattccatcatggtgactgccgtctccctgccataggtttcctcccacatagatgtgatccaggaaggcatggaatagcggatggagtcatcaggccaggtaatgccctctttatttctggaaatatttctcagcacgccgttgacaaagccttttaatcctgtaaatttacgctttacggcaagctttaccgcttcattgcacacggctgaatcaggaacacggtccatataaagaagctggtataccgacatgcggagaatggtgcgtatcaccggcttcattttctgtacttttgtattggaaaaggaattgatgatataatcgatctgaagcaggtattccacggttccttctgctattctggaaatgaaggcccgttccggtttatttaagtactgatacttattcagggcctggcgcaggatgatatggctgtagcctccccgctccaggatctcaaggaggatatccagcgcaatttctctgctatcgcccacgctgccggtctccttagtcatcattccttcttcctccgaacaggatcaccagccttaaaagctgcagtacggtggctgcaagggccgccacataggtcagggccgctgcgcccagcacttttctggtatagcctaattcctgatctcctaagatccctacctggccgagaagagtgactgcccggctggatgcattgaattccacaggcaaagtgaccagctggaaaataacagccagagaaaacaggatcagcccgatattaacaaggggagaaccgattcctccaatgataactccaagaatgatcaggggcagcgctgccttggaaccgatattggctgcaggaacaatggcccccgaagctttaagggaatgtagcctgtatggtcctgcataacatgaccgcattcatgtgcagcaacgccgattgcagcaactgaggtagaaccgtaaacagaatcagacaagttcacggtcttggtcctggggtcataatgatccgtaagctgcccgcctacggaccttacctgaacatcataaatgccctgggaagtcagaaggcgctttgccgcttccgcaccggtcattccagacatacttctcacctttgaatatttgttaaatgtactgtttacccttgcagatgccaccatggacaaaactgctccgatgataacaaggatccaggtgggatccatataatatcccatcattccgccataatacataatcagactctcctttcttctttcctgcccaagctttccgggcttgaaggtataccggcaagccgttctaaaacagcgccttccccaatgtggtatccgcggagaaatgcatcaatatccatacatttttttccctgcagctgcagcttgcggatggacaagccgccttttccggtctttatgaccagagagtcacggcctgcttctgccacctggccgcagacgccctcatactctttatccacaacttctgcttcccacagttttatcacttttccgttccaggcggtataagcgctgggccatgggtttaatcctctgatcaggcgttcaatggatactgcatccattgaccagtcaatatctcccatggacttttttatcaggcctacatagcaggtcccggaatcatcctggggaatgcggatggcagtcccttctttcagcttttcaatggtttttaaaataagtctgcctcccatcgcgctcagcttatcgtgaaggctgccaaaggtttccttttcttccaaagcaacggtttcctgatccagcatatctcccgtatccagggattcagccatcatcatggtcgtaactccgctttccttttctccgttaatgaccgcatactgtatgggagatgctccgcggtacttgggaagcagggacgcatggatatttacacagccgtattttggaatatccagaatggatttcggcaggagctgtccaaaagcgattactacgatcaattccggatccatatctgataagattttaacaaactccggatcccttgccttgaccggctgataaacagggatctggtattccagcgctttctcctttacaggagtcatctggacttccttacctcttccctttggtttatccggctgggtaactactgcaagaatttcatgcccggcctcctttaacgccacaagggctggaacggaaaaatcaggcgttcccataaatatgatacgcataattattcttcaacctctccttcttcttcctcctcgtcaggggtgacatcctccagctcgccttccaccttgtctacgtataaatcaccgtttagatgatcgcattcatgacagatcgccctggctaaaagtccttccccctccagttcataaggctccatggcatcatcataagcctttatttttacgtattccggccttgtaacgattcctgattttccaggtacgctaagacagccctctggcccggtctggcttccccttgtctccaggatttccggattaatgagaacatactggttgccatcctcaacatccaatacaacgatttgttttaaaacccccacctgagaagccgcaaggccgactccgttggaatcatacatggtttcaaacatatccccaatcagctctgtaatccttggtgtgatctcttttacaggcttacagtgttttcttaaaatttcatctccaatggttctgatctttctaattgccattttcctttatcctctttcttgcccattctttccgggcataaaggtatgcccgaagggtgtatcctctttcttgcccgtgctttatgggcataaaggtatacccatagggtgtatcctctcatttatgaaaaatcatattggaccattacctggtcaaacagtgaccggtgatcttctgaaaaaacgtcgatctgatccctgatttttattagtatatcatagttttcctgtttcaagtataaaatttttctatagatatcattaattttgtaaaccgacgcctccacagggccgataacctgtaccctttcctggtccgccaaagaagcgatgaatccggctgctgctgccgcggcttcgcttaacaggctttcctgccgggaagaaaactggacggttaaaagaccgcttgccggagggtatttcatcaggcggcggtatgccatttcctgccggtagaaggcttcgtagtcctgatttgcagcagttacaatgctgtaatgctccgggctgtaggtctggatgaccacatcaccgcttcggaaatcacgtccggcccttcctgccgcctgagtcagcagctggaaagtccgctctgcggagcggtagtccggggtatttaaagataagtccgcagccaatacccctaccagggtcacattgggaaaatcatggcctttcacgatcatctgggtgccgatgaggatgtctgcctctccctctgaaaaggcggtgagaatctcttcatggccccctttttttgaagtggtatccagatccatccgcaggactctggcagccgggaacatttttttagtcatctgttcaattttctgagtccccacaccgaaattagcgatgtatggagagctgcaggacggacagcggtccggcattgatatggaatatccgcagtaatggcatacaaggcggctgttattatggagtgtcagggtcacatcacagtgggggcagcgaatggcttccccgcaggaacggcaggatacaaagttcgcatagccgcgcctgttgataaacagcatgatttgttcccgcttttccagccggtcttccatcaaagcctttaaatttcggctgaaaatggacttgttgccttccttaagctcctgccttaagtccactacagatacgtctgcaagacggctgtctttttttgcccgttctgtcaggcaaaaaagccggtattctccctgaagggcttttgtataagcctccagggaaggggttgccgagcctaaaaccagggatgccccctgcatggaagccctttttacagccacctccctggcatggtatcttggggatacttcgcttttgtaagccccttcatgctcttcatctatgagaatcaggccgaggcgggaaaagggggtaaacagggccgagcgggggccgatcatgatatcaatatccccgtttcttgcccgttcaaactggtcataccgttctcctgccgataatcttgaattaatgatggacacgcggtttccaaatcttccgtaaaaacgaaggacagtctggtaggtcagggcgatctccggaatgaggacgatcacctgctttccatcctttatgaccctttggatcaattccatataaacctccgtcttaccgcttcccgtgatgccgtgaatcaaataggtctttcttatattttgagagtaatccagacaaaagctgtctacaatggtttgctgcccctcatttaaaagcacactgcgcccttcttttgcctctgccttaacaggatttctgtaaacctcctcacggtcaaggcttacgtatccttttcaataaccggttttaaggtagctgcagataggttcatctgattgactgcaatttcatagggaatgacggaatttttcaaaagtgcctgaaaaagccgtgccctggccttatagctctttttttccgcctcctctaaggcttttaaaagctgagaatggtccaaaaggcttctaagcacctttttttcccttggtctcaccttttgcttcacaggaagcacggtttttaatgcctggttcatggtggacccatactgctctttcagccaccatgccagggagatgagcagggactccgctgatacgccatccgtcacgatccctgctatttccttaatcttatccgaatcataatcagcatgaccggcaattccgaccacatatcctttccgcatggaattcccttttccaaaagggatcaaaaccagggacccaacagcaacctcctcaagaagctctgccggaatccggtaatcaaaggttctgtcaaccttttcatgggaaatatcaataataatccgggcaaatcgttctgccattggtttcctcttttctgcccatgtcctttgggcataacaggctccaaaagactctcagttcaagtaaaactcctccgccaccggactgagcttcatgctgttggagcctttaaacagcacgcagtccccttcctttaattccgcttttaaataagacaccagcccatccggttccatgaattcctttaccagaatctgaggagcatgctcctttacggctctggcaatttcccctgccagctctcctaaggtcaccacctcatataccggatgctctgcaatgtattctccgatttcataatggtattcgggagatttttctcccagctccttcatatcggccagtacagcgatccttcgttccgcttttgtgatggaacccagaacctccagtcccgctttcatggaaacaggacttgcgttatatgtatcgtcaataatggtcatgcctcccacgtaataaatctgctgccggttcttaaaaccggtaaattcctgaagacatttggcagcttcctccatgggaataccacactcggatgccaccgcaagagataccatggcattcagcacattatgacttcccattactgtcaggcgcacagggaccctattggggccgaaagctgcagtaaaggccggaaagccctcttccaaatgaacatccaaagccctgtaatcgcaattttccccggttccgtaatagatggtcttacagccttcttttgcctctgttgcctttaaaagccggtcatccccgtttaaaaaaaggattccgcctttttccaacccatcctgaatggtcagcttttccctgtaaatgttttcctgggaaccaagctgctcaatatgagtcactccgatgttggtgatcacagccatctggatctttgcaatctttgcaataacagtcagttctcgcggctcactcatccccagctcaatgactccgatttcatcctctggagatatttccgatatggtgatgggtactcctacctggctgttatgatttccaggggtcttatagacagaataacgtgcagacaaagcgcaggccaccatctctcttgtggtggtctttcccacgcttcctgtaatgccgaccaggggaaggctcagacggtctctgtaatagctgccaatggcctgaagagcctttttcgtatcttccactctgatccacggtctggccgagtccatggcatcatgccggctggtaaggaccgcagcagccccgttatcaaaagcctgctcaataaaacggtgggcatcctgtctttccccgatgatggggacaaacagatcattccccttcattgtcctggaatcaatgctaatatgttccagaaccgtatcctcacttccgcaaagaagtcttccgcctgtggctgaaagtatttcctttaccctcatattcaccattacttcctccgttccatgttcgcctccggcgtacattcctttcatctgtcatctaccgtggaaatgccgaaagccgcattttcttacggcttccggcattttctttatgatcgctgccttcctttttaagcttcctttgaaagctgggaatccaccgcttttaaaacctcttccctgtctgaaaagtggtagcggaccccgttcatttcctggtaatcctcatgtccctttccaatgatggcaatcatatcgcctggctgggcatgagtgatgctgtagcagatcgcttctctccggtccggaatttccatgaatttccctccggtcttttcaagacttcccctgatatctgcgatgatatcttctgttttttcgtacctggaattatccgcagtgatgatggtaaaatccgccagacgtcccgcgctgtctcccatggaaatgcgccggtctttggaacggtttccgccgcagccaaatacacagacaaggcgtttggggtgataatccctgagagttgaaagcaggctttccatgctgacggcattatgggcataatccacgatcaccgtgcatttttcagaagcatatacgatttccatacgcccgtttacatttaaatgttccagaccatggcagatattctccttgggcagccctaaaaagcttaaaacgctgactgcagccagggcattggcaacattaaaccggcccggaatattcacccgtacagaaagctcgcagatccctttgatgtcaaattccagtccgacaaaatccggctgggcgatatatcggatagcctctgccttaaaatctgtatcctttttctccatggaaaaggaatagagcctgcaggaggcatcctttattacttcctcccaatggtcatcatcgccgttcatgattcccactttacagcaggaaaagatacgggatttataataaagatattcttcaaaatccttatgctcatccggcccgatatgatcaggagaaatattggtaaacagtccataatcaaaacggatcccgtctacccggtgcatcttaaaggcctgggaggaaacttccatcaccatgtattcacagccggcctctgccatacggctgaaagcctggtgaagctcataagactcggggtggtattcaccgtaggcgttacttcctggccgatgacaatacctgtggttccgatcattcccactttctttccgcaggcctccagaatcgttttgatcatgtgggtggtggtggtctttcccttggttcctgtcacgccgatggtcaccatcttttctgcaggataaccgaatctggctgccgcaagaagagccagggcttctcttgcattatgtacaaggacagcggttacgccatccgggatctctgtccttcgttctaatacaaggatctccgtccctgcagccaccacgtccgggataaaatcatgggagtcggttcttgtacccttcatacagacgaatacaactcccttccgggcttttctggagtcataaatcacatcctctgcgtctacgtcaaggcttccctgtattacctcatatgttaagtcttttagccattctttaaacttcataaaacctcccaatcagaataatccggtgattactccatcttcatttacgtcaatattatctgcggccggcttctttggaaggcctggcatggtcatgatggctccggttaaaatgaccacaaagccggctcctgcggatacgtaagcatcccgcacggtaatgtcaaagccttccggccgtccaagctttgtctggtcatcggataaggaatactgggtctttgccatgcagacaggaaggctgccaaagcccatttcttcaaattttctgatggcttttaaagccgccggagcataggacaccccatttgcaccgtagatttcccttgcaactgcggccaccttatcttccagtcccatttcatcaggataaaggggagcaaagctgctttccttattttccagggtataaagaactttctccgccagctctgtaccgccctctccgcctttttcccacacctgggataaggcgaattcacagcctctctcttcgcagaacttctttacaaaccggtattctgcctctgtgtcggtgataaaggaattcagggtaacgatgaccggaactccgtatttcgtcatattttcaatgtgcttttccagattgacaatacctttttcaagggcatctaagttctcttcctttaactggtcctttggcactccgccgttgtatttaagagccctcaccgttgcaaccagcacaatggcatccggctttaatcctgccttcctgcatttgatatccaggaatttttctgcgcctaagtcagcgccaaaccctgcctccgtcacaacgatatcggccagctttaaggccgtctttgtggcacgtacgctgttgcagccgtgggcaatgtttgcaaaggggccgccgtgaacgattgcgccggtatgttccagagtctgtatcagatttggctttaaggcatcctttaataaagcagccatagctcctactgcatttaactgggaggcagtcacaggctccccagcataattatatgctacaataattcttcccagccgttcttttaaatcttccatgtcatttgcaagacaaaggatcgccatgatctccgatgccaccgtgatcacgaaatgatcttccctcacaaaaccttccgccttggaaccaaggccgaccacaatatttctaagggcgcggtcattcatgtcaaggcaacgcttccagagaatctggcgggtgtcgattccaagagtgttaccctggtggatatgattgtctaacagggctgcaagtaggttgtttgccgaagttatggcatgaaaatcaccggtaaaatgaagatttaagtcttccatcggcacaacctgggcatagccgccccctgccgctccgcccttgataccaaagcatggtccgagggaaggttccctgagagcgatcatggcattctttcccattttccctaatgcctgtccaagaccaacggtagttgtagttttcccttctcctgccggagtggggttgatggcggtcaccagaaccagcttgccgtcagtacggtcctttatccggtcccatagctcgtcagtcagctttgccttatatttcccgtaaagctccagttcatcttcactgatcccataggaagcagccacatccttaataggcagcattgctgcctcctgcgcgatttcaatatctgttctcatttcccagtcctccttctatgtaaatgatacagctttatttaataaccctgggaaagcatttcatcaaattcctccaggctcatcaataccttacgggcttggtaccttcctcttcccccactacaccggcttctgccagctggtccatgatacgggccgcccggttaaagcctattttaaacattctctggagcataccaatggatgctttgtccttttcaatgataaatttcccggcctggacaaaatattcatcccggtcatttccgccgcctttggtctctccgcctacaggtgctgaagtgatcatgctttccacttccggattataatcaggggtcattccctgctctgttaagaaatccaccacctttgagacttcggaatctgatacaaaagcgccctgaacccgcattggctttggatagcctgccggataaaacagcatatcacctttaccaagaagcttttccgcaccgttcatatcaatgatggtcctggaatccacgccggaagaaaccgcaaaggccaccctggatggaacattggccttgatcagtcctgtgatgacattgaccgaaggacgctgggtggcaataactaagtgaatgccagccgctctggcaagctgggccaggcggcagatggaatcctccacctctccaggggcaaccatcatcaaatccgcaagctcgtcaatgatgatgacgatctgtggcattttcttcggcttatcctcatcctcaatgtcctttatgctttccaccttttcgttatatcctttgatttccctgacattgtactgggcaaacttattatagcggtccgtcatctccgccaccgcccagttaagggcaccggaagcctttttcgggtcagtgaccactgggaggagcaaatgaggaataccattataaacgctcagctccacaaccttgggatccaccatgatcagcttcacatcctcagggtcagccttaaagatgatgctcatgatcagggtgttgatgcacacggatttaccggaaccagtagccccggcgatcagaaggtggggcatctttgcaatgtccgtgacaaccacctgcccgccgatgtccttgcccaccgcaaaggcaattttagaggaatgtttctgaaaaccgtctgcctccagaatatcccgtaagtataccatttggttttctttattgggaacctcgattcccaccgccgattttccgggtatgggggcttcaatacggatatccgcagccgctaagctcaatttaatatcatctgccagacttacgatcttgctgacctttactccctgctccggatgcaactcatacctggttacagaaggtccgcagcttatattggttaccgtaacccctacaccgaaattctgaagggtcctttgaagcttgatagcggtatccttgtattctctgtcggaaaaaaccgacgttttcccttttttaaggagggagaggggcggaaatttatattccacctttacggtctcctgcttttgcctgatttcctggctgacgcttaaaccgtcttcctttgatgccccttcccgtttcttttccagttttttctgaagggcttccgtatctgtctctatgatctttccggaagcagtgaccacctgctttggttcctggggaatggaaaaggtgtcattttcctcaacaggatagacatcctcttccacaacctccatttcctttaaggttctcatctctttcttcatatatatggaagattcttccagagcctctccaaaagccccagtccctccgtcaggatcaaagggaacgatatcctcttcattctccacgaccggcgaaatactgccccggaaaatatccgccggattaggttcggcggtttctacagcggtaagggcagacagccggtctgcctgggccataatatcctccccaagatcattggaaatttcctcagccggttccggataattttcttcctgggccgcctccagctttgtggcgtctaaattgactccacgaagcttttgctcttcccaaagctgcctgcgggcttcctggcgctttgcatggagctccatatgcatatccacattttccttggcatgacggtacgcctttccgcttccctttttcacaatatctacaaaagacttttccgtaatgcatactgcagatatgacaagaaggacccctattaccagataggctcctacaacgccgataatggaggtgagacctccggccaggagaccgcctataataccgccccccttccgctgacagaggcttcaaaataaatgtcggcaagtccagctccctcaccggcttttccgccaaaaaggagctgtaaaaatccacacaaagaaaccagcgccagaataaaagacgccagtttaaaagctgccctgggatttccctgattggaaatgtaaaacgccgttcctgcaaacagcagcacaggcgctatatatcccacacttccgaatatgccaagctgtatgctccgcagaaaatcccctaccacgccgcacaagtgaaagttacttaaaaacagaatggacgcagccaaaaatgacataatgatcactacttctgaatggataaattccggttccggcaaaatcacattttttttggcgccggagtttcttgttctcccgttttttcctttttttgctgttgtacgtttcttcgttgtctcaggcacaatacttcccccttctatccgttggtaacagtatacaaaaaaatcgggagaattgcaacgattaacgggaagcagtttccatcagttcatataattttttcaaagcatcctttattccgcctacctcgttgatcaggccttcttttacggtttcctcgcccacgagaacggtgcctaagtctctggtgagcatttccgtattcagcataaggcgcttcaactgatcgtaggcaatctctgcgtgattggaaacaaagcttaaaatccggtcctgtatcatttcaaaatattcataagtctgggaagcgccgattaccattcccgtcattcttaccgggtgtatcatcatggttccggtgggcacgatgaaagaataatccgtgcagactgccagtggaactccaatggaatgacttcctccaagaaccagggatacagttgggacgctcaaagaagcgatcatctcagcaatagccaggcctgcgtccacgtcaccgccggaagtatttaagagaaccaaaagcccttccactgaatcgtcgtcttcaatctcagccagtttcgggaggatgtgatcatattttgtagccttgctgtttccggataaattctcatggccctccacctctcctataatggtaatcagatggatttttcgcttgtttgcattgtcatccaaagtggcctgaccatattcttccagcttttcatcctctttctgctcaatatccttttccgtctttttttcgtccaggttttccttgcgtgtattgtcggagggcttattctgcctttcgtccatatcttcattcttttgattatcattattctgatgttctctcaccttaaaaacctcctgttttgctctgaatttggtaatatcttatgatgtggagaaaaccataaaaatatgcttgaaaatcttaaaaccggattttacgtttccatacaaaaggccagtcataaaactgccggaataacaatattttagttgtgattataacaagttattgactttgatacttttccatgttaaactaccaaacaataaaaaaagtcacattcttgccaatggaggcagcgccggggatatccttttgcgctgcttttctataaacggatacatattcttcaggctgtggcttaactaaaaaaaaggagagatcgttcatgaacaacttttttattgctcaaacttttggtaaatcctcaaatttcacggatattccaaaccatttatttaaggaacacaatgtaaaaaaaggcctgcgcaacgaagacggtaccggagtccgggtgggcttaacccgcgtatctgatgtagttggctatgaaatccaagacggaaaaaaggtgaacgttcccggcaagctctattaccggggaatcgagatcggcgacctggtaagcggaaaaaacagcgagcgctacggctttgaagaaacttcgtttttgctcctttttggttatcttccatctaaaaaggaattaagggagttcacggccaccttaagccataactatcttcttccggatgagtttctggaaaagaacatgctccgttctccttcccgcaatttaatgaacagccttcagcggaacatcctgtccctttacgattatgacgaggagccggataatgtggatccttatcggaccatgttaaaaggaatcaacatccttgcaaagcttccttctctttccgtctacgcataccagagcaaggttcatcattatgacagagacagtctgatcatacattatccaaaacaggaatattccatagcagaaaacatcctctacatgctgcgccgggatggggcctttactgaacaggaagcaaatctgctggatgtaatgctcatgatccatgcagaccatggcggcggaaacaactccacctttaccaatgtagtcatatcttccaccggcaccgatatttattcagccatttccgcttccataggctccttaaaagggccaaagcatggcggtgccaacatatgctgcagcgaaatgatcaaggcgattgaaaaagaaatcgggtttaaggcaacggaaaaccagatgaaaggaataatccagaagatccttgcaaaggatttttatgataactccggccttgtatacggacttggccacgcagtttatacggtctccgaccccagggcggatttattaaaagtctgctgtgaaaagcttgccaaacagaaaaacagggaagatgaatatgaatttctgacaaaatttgagaaagttgccaaagcatgcctggcgggaaacggaaaaaccctgtcaaacaatgtggacttctacagcggtttcgcttataatatgttacagataccggaagatatgtatacgcctctgttcgtctgctctcgtatggcaggctggctggcgcacaatatcgaaaacaagctgtatgacggaagaatcatgcgtccggcaacaaaatacgtaggagaaaccatttcctacaaaaaaagagaggaaagatagcatatggtgaaattgtatgacggcggggcttatcttgttcatggaagggaactggttccggaacaggaagctttaaaagtggctgcccttacaggaaaaactgcagataaggctgaagccaaaaagggcaccatcgcctattccattttaaaggaacacaatacctccgatgacatggatcatttgaagctccgttttgactccatggcctcccatgacattacatttgtagggatcatccagactgcccgggcatcagggcttaaggaatttcccattccatacgttatgaccaactgtcacaactccttatgcgcagttggtggcaccattaacgaggatgaccatgttttcgggctttccgccgcaaaaaaatacggcgggatctttgttccgcctcatattgcggtcatccatcagtatatgagggaaatgatggccggatgcggacggatgatcctcggctctgacagccatacccgttacggcgccctgggaaccatggctatcggcgaaggcggcggggaactggtaaagcagcttctgcgggatacttatgacgtgacatatcccggcgttgtggctatttatcttacaggaagccccgccccttctgtcggtcctcatgatgtggccctggccattatcggagcggtcttccaaagcggctatgtaaagaacaggatcatggaatttgtagggcccggagtttcttccatggatacggactacaggaacggcgtggatgtcatgacaacggaaaccacctgcctttcatccatctggagaaccgatgaggacacaaaggcttatctggatcttcatggacggggagatgcttataaggagctgaatcctgaggaagtggcttactacgacggagtcgtttatgtggatttaagcaccattaagcccatgatcgcactgcccttccacccaagcaatacgtatgagatcgaccagctgaatgcaaacctgggcgacattctccggaccgtggaaaaagaagcggagcgaattgtgggaagttccaaggcaagcctttctctcaccgacaagatcgtggatggaaagctcatggttcagcagggagtgattgcaggctgcgccggaggcaactactccaacgtcatggctgcggctcatattctgtcaggaaaagactgcggaaatgatatctttaatttatccgtgtatccttcctcccagccggtatacatggatctggtgaaaaagggagccatctcggaatttatggcagccggagcgactgtccggacggccttctgcggcccgtgctttggtgcaggggatactccttccaacaattccttaagcatccgccacaccacaagaaacttccccaacagggaaggctccaagccgggaagcggacagatttcctgtgtagccctcatggatgcccgttccattgcggcaacggcggcaaacggcggctatctgacctctgcggaaggatatggagaagattaccgtgttcctgcttatgaatttgactcatcttcctatgacaggcgggtatatcagggctttggaaaggctcagcctgaggcttccctgatttatggtcccaatatcaaagactggccggccatgagcgctttgacagaaaacatccttttgcgggtatgttcaaagatcatggatcctgttactaccaccgacgagctgatcccttcgggtgaaacctcctcctaccgctccaaccctctgggtcttgcggaatttaccttgtcccgccgggatccggaatacgtggaacgttccaaaaaggtaaatgagctggaacaaataaggaaagcaggaaacaccccattagaagccgatcagtctctggagtcagcatggaaagccctgagctcttacttaaaccagccggagctgaaggcaggtgaaacggaaatcggaagcatgatctatgcggtgaagcccggtgacggctctgcccgggaacaggcagccagctgccagcgagtgctgggcggcctggccaatattgccaaagaatatgctaccaagcgataccgttccaatgtcatgaactggggaatgcttcccttccttcttgatgaggaacctgattttgaagtaggtgatttcatctatgtgcccggaatccgcaccgcccttgacggagatatgaagcacattccagcttatgtggtaaaaaacagggacgggaatccgattcatgagattaaactgcacattgccgatatgaccccggaagaacgggaaatcgtaaaggccggatgtctgatcaactataatagaaataaaaaccaacagaaataatctttaaaacaggaatcccccggacttgaaactggcagaaaggccagatccaaaaccgggggttatgttttttatttcaaaattttctccgtctgtgtgtcatcaagatttacgtgataaaacagctggtagaaatcttttacttcctgttttatatcaacgttatactgctccggatatacaagattgcccagccacataatcccgatcattcggttgacagaaggcgggctgctcataaaactatatggaacagaaggtatctgataaaccttaccttctttcactgcatttaattctccccagaccttatctgttgttattgtctggtataaggtctcagaatctgcgatgataatatccggctgccacagaagaagctgttcaaaggatacttcacttccgcctccgcttgataccatttcaacttttgccgcattttccgctccgatctgttcgatgacccgggcatgaatggaaccctctgcattggtgtgaagtccatcatctccaatggcaaaataaaccgatttcttttctttttctgccagttcttccttggctgtttcagattttttcaatatattattacaatagtccgccagcttctttgcctgatcagcctcgccggtaagctccccaagcttttcataagcagcactcatggtatctaaatctgcctctataaaaatgaccggcatgttaagctgttcctgaagggcatccatatcctcttttacggttttcttcgcttctccgatatcaatgatcacatccgggctttctgcaatgagagcctccatattaaggcttgcattctttccataaaactggccgaatttaggaagtccccaatatttttcgtcaatatacagctttgcaccctcagaaaaatcagaagcaagtccggacagcttatccgggcacagggtataaagcacaatctgtgccaatggcccggaaggagcaatcttgttaatttcctttggaagtgtaacttctcttcctgctgaatccgtaaatactctggtctctgactgtccccctgtttcactggatttttctgtttccgcctgagtttctgcctttgcaggcgcagttgactctgtctgagtggcaggtacctcattactgttttccttttggcagccatttgccagtaccgcagcagcaaggaatgcagccaataccagcccttttctcatttttttcatataatccccctattctgccgcatttgcggcttatatttattttagggaaagccttaccggtaaaccagaacggattaccgccttgtgctctccttttttaacaaattcctctgtaagctttttatctgtaataagtgtgcctgccagctcccacacaccaaaatcaaaaagttcaggagcaagagccacactgggccccactaatatgactttggcattccgcgacagctccaacagccttggaagggttttattaaccagggtaaatccagtgataaatacataatctctgtctgaaagaacatattcacaggcactgtccggataatcgccatcctttggattgcgttccagaattacgcaggattttgcttctttaaaatactcctcagcaaagcagaaatgtccgatggtcgccaccttttttcctttgatatcctcactatgtgccataaaggcatcttccctggacaacatcctgattgcaccttccctttccagcctgctgatccggtccggctgattataataggcatttaccgccgcggcacctatgctggcttccgtaaaattccatgattttatcagtcctgcagcttccttccatgacatgtccaagatatttttttcagttcttgatatggtctgaagcggatttgtcgccgtcgcacctgtacagccgcagacagtcaccgaagtccactggattccggcaaaataatcttctatctttacgtcatctggtattggttctatcagactgtcatacatttcccacatattcatcacccttccccaggcatacaaacctttttcccgctttttaaatcttcatagatctcaattggcacctggtacacgccttccaaaagctcctttgtcaagatcttgtccggctcacccaaagcccttatctttccatccatcatcaccagcgatttatgggcaaagtgaaagacatgctccggattatgggtggactgcacaattaaatatcccttttctgacaaggtacgcagctccttcatgaccctgatctggttgccgtaatccaagctggaacatggctcatccatgaccagtatttttgcctcctgggcgattgcccttgcaatcagcacaagctgctgctctccgccgctgatctgcccgaatatacggtcccttagaccagcaatccttaatagctttaaagcattcattgccctgtctttttcctttggtcccggccctgcaaagcggggcagggaagcggttgttcccatcaaaaccatatccagaaccgaaaaagagaatgcagtatcgtgattctgggggatataggcgatccgtccggccaattccctttctgaaaagtgccggcgttccgttccgtcaatcagaatctccccctggtatcccttcagcaaacctaacatgcagcgaaaaagcgtactcttccctgctccgtttttcccaagaacacagaccagttctcctttgttgaaggaaaaattaatcccctttaataccggaaaacaatgatagccgaattctaaatcttttaccgtcagttccatatctcctcctctataaccggtttccttcccgtaaaatcagatataaaaagaacggagcaccaacaaatgcagtcaaaatgccgataggaacctcactggtagccaaaagccttgcaaaattatccacgatcagcagaaaactgccgcccataagcagggaggccggcaacagcctgcggtaatcacttcctaccagcattcttgcaaaatgaggaattaccagtcccacccagccgatatgcccgcttactgaaactgatgctgaagtaatcaaagatgcactgacaacaatgataagacgaagccttcctccattgatccccatgctcctcgcctcctcttccccaaggcttaaaacattgatccgccaccggagaagataaatcggaaggattcccatcaggatccatggagcagcaaacatcacatctttctgacggatggatgccaggcttcccataagccagtaggtaatgaccggaagtgtattggccggatccgccaccagctttaaaaaagatactgctgcggaagcaagggaacttatcatcatgccggacaacaccagccccagcacgggattatattttacccggctgctgatgaggcagacaattcctacggcaccaagaccaaaaagaaaggcactgattgttactccgttataacccaatgacaaaaacagtcccagggcagcgcctaatcctgcgcccgaggaggctcccagaacatccggtgataccatgggatttttaaaaatcccctgataagcggcgcctgcacaggacaatcctcctccgatcaatgctgccatgaaaactcttggaagacggacacgaaaaacaacagtctctatctgggcaggccaagagatttctataggaaaaactttggcaagaaggacttttaaaagcgtgtccgggtataccgggtaccgtccaagcaaaaaggaacccaaaaagcagacaataaataagagcactatgattccaaaacgtcttttataaacccagtccctttctaccatgtgtttccattccttccttttccccgcattctctcaaaaaatccataatttccatacggatgtgttcttttctgtcgcgctcaaacgtaagtatccgcccatttgaccgtttttcaagtttttcctccaagtccaggagaagcttgtccgtatccgtctgtatggggattctggtcctcatggactccagatttttccggttttttaatactccgatgcatggaaccggaccatcaatacagcaaagaacctcctccataaattccggcacaaaaagctctaccccgcctatttcatccaaaaggcagagtctgctctgagcggaagaacgcagaatatccacaccaacggtttcaaaaagttcaggatttttatggaatccatgttcagtccgttcaataaaaacattagtcattccttttttatagggagctgccggaatccagtcttcctctgcaggaaccattcgaaatcccatagtcattccatcttccattattaagcgctgtgaataaaaccctcccatcagccggtgccaggatcttaaacattcaaaaagcaaggttgtctttccttctccggaatcaccttttaaaaacagaaattttcccattatttttttcgcccttcccgcagagccctgacagcaatcagttctcctgccacactgatggcgatctcagcgggtgtttctgcataaatttccagaccgatagggctgtggcagctgtcgatctgttctctggtaacgccgtctgccataagctttccggccagagtttccagcttccttcggctgccgattacgccgatataacagacattttttgtaaggacctgtctttggacaacataatccgactggtgtcctctggtcataacacagacataatcacattcccttaattcaaggtaatcaaaaatcctttcataatcccctgcaatggtcttctctgcctggggaaacagtgtttcattggcaaactccggccggtcatcaaaaacagcacaccggaatcctacatgcgccaggaccggtaccaattcctgtgccacatgtccgcctccaaaaatatagacacagccggcccggaccagaggctcgctgtaatacttgcgttcaccaaagtttttctgaaccgccttattctgaagaagaatttttctttcttcttcagcaattccttctattcctgtaaatcccgctgatttactgtagattcccagcccccatgtggattcactggaaatatccataataagccagctgtcttcatccttgtcataggcttcttctatcctcctgcacaagtcaataaattcctgattttcatggtccaaatactgaaagtataccaccacatcgccaccacagatcatgcccagatcagctacctgttcttttcccaggacaaagctgtggatataggatgccttttcctcaatcgccttttgtgatctctgaatggaccggtattccaccgctccgcccccgatagttccttccgtggtcccgtcccgccttaccagcatatgggatcctgcacctctgggagtggatccggagcttgcaataatggttactaaaactccatcctcgcctttttccaaagtttctaaaactgctttaaacatctgcctcattttaataccccctcaaaatatttcataaacagttcttctgttttttcattcaactctttttccatgcttaggaaccggttcagaaaatccttagtcttaggtgtgagttgggaaaatccaccctctgctccgtctgataacggttgtccctccaatgggcatcaatggtttaaatgtactggcggcacttttatgtcccgccgcaaaaatgaccgcacctgccttcataccggatcctgcctttccgttgtattttcaaaattataacggcgtactcattataatccattttccagaatttgtaaacccggggaaaagcaaaaagctcccggattgaaatttaatcgaaatatcaattaaatttcaatccggaagccttaaatcaatcaccgatcatatttcggatccttaccggtgtccggtaattccatgtagatatttttataccgcttcgcctgctggctgcatgtacgatctgaccgtttccgatatacatggccacatggttgatggttcctttgctgtctgcataatagatcaggtctccgggtctcatctcactggattttaccgccttgcccatgcctgcctgagagccggagtaatgaggcagcccgatgccgaaatgagcataaacagataaagtgaaaccggaacaatcagcccctttcgttaagctggttcctccccacacataaggatttcccaaaaactgcagggcataatttacgatctgggtcctgagggaagcctgtgcattggccttttcctccaacggggaaaatttgatggcctcaggaagcgcataccggacatccacaaaatctgtggatacgtaagcgctgctgttttcctccagctcgatctcaatccagccgtcaatctgctttaatacaggataccgctcattgttggatatctgcgtccatatctttgaatcagtggaaggctcagtcctggcatttaacatatccgtgtttacaatggccataagctccgccacctgcattgcttcatcctttgccgccggtcctgtgaggatataatcggactttacatagcctgtaatattgccggactggatcttataccatccgtcttcagtagtctccaaaatgtttcctgctgctttgctgggcattttcccgatgattttgccgttttcgctgggctcttctcttacattcagataattatccacatctgaaatcccgatattcttgtatagattaaatatcattgcctttaaatccagctttctggcctcgttcagtccgtattccagatttacgtagtctgcggacagatacccagtgggaatttgtacccagccctccgtctgtcctatgacctcataccgctcatttaaaagtgcctgacccaccacatccgaactggtggaaggttccttcctgatgttcatattgtcggtctggacgacagccctcagctttaccaagtccattgcttttgtctttgcatcttcccctgtcaggacatattcagaatttatgtatccttcaattccgccggaagatattttaaaccatccggattctgtattctcaaggatatcacaggcactgtctccctgaagctttccaattacatcttcctcggtaccaggtgcctttctcacatttaaatagcccgatacctggatgattcccaaattcttataggaatttattaccgtttctttttcctctttttcctttgcggcctgggcagcagactcagattcagctttaacctttaaatccgctgattcctccggcttttgggcagaggcatcagatcctgtggcaaggcccgccggctttgcagacatgtgattttttatcgacattcccgccgctgaaatgactgccacgcaaagaaccgctgcgcctcccagtgtcataagtttcttgtaatcattctggctgcgtttttttctggccttatccaaacggattgtataatcttttttctcgttattgttttccatcctgtactttctctccatcttcctgttttctagcggaaagccgattcaggctatgagcctatctgtctaattatagcataaaatgtcattctttgcgatacaggtctcataaaaaattattaagattatgttacaaacaattaaaaaagatatatccgggaaataccttgataatgaatctccggacattaaaacaaaaaaacacagggcaggaagcacatataaagggctcctgtcccatgttttttacctgctattttgccagaatcattctgtcgttggaaaattcttcaccgctggcttcctcaaacttcttaagtaagtcttccacttccagcttctttttttcttcccctgaaatatcataaatgatgcgtccttcatgcatcatcacaagacggttgccaatctggatggcatccttcatgttatgggtgatcataagcgtggtaagattctgctccttcacaatttcctgagtgatctccagaacctttctggctgtctttggatcaagtgcggcagtatgttcatcaagcagaagaagctttggcttctttaaggtcgccatcaaaagggtaagcgcctgtctctgaccgcctgaaagaagtcccaccttgttggtcatacggtcctgaagcccaagtccaagctttttaagggcctcatggtaaaatgccttttcatttgccctgattccccaggcaaggcctcttccctgtccccggcgataggccagcgccatattttcctgtatctccattccggcggctgttcccatcataggatcctgaaacactcttccgatgtacttggctcttttatactcgggatccctggatatgttaattccatcgatctggatcttgccggaatcaatgggatacactcctgctatcatattaagcatcgtggattttcccgctccgtttccgccgatcacagtgacaaaatcgccttcattcagatggagatcaatgccatttaatgcttttttttcatttatggtatttttattaaacgtttttctgacattcttaatatccagcacagtttattctcctccctctgtataagctttcctgatgcgccatttgtttaccatgaccggaacgcaaagcgctacagctacgatcccagccgacaacagcttcatatcattggcatccatacccattctcaaaacaacggcacggattacaaaatatatgacggagccgactactgcagaggtgagtttgcttccaaaggatcgtaatcttcccataagcacatcaccgataacaatagcggcaaggccgatgacaatggcaccagtccccataccgatatccgcatatttctggctttgacacaccagtcctcctgaaatccccacaagcccgttgcttaaggtaagtgccagaagctttgtccagttggtattgacgccctgggcacggatcatagcctgattattgccagtagcccgcatggcactgccgatttccgttccaaagaaccagtaaagcagtgcaatcataataattgcagccccgattccgatgatcatggcggcagcctgtttgcttaatccgcttaccgctatgaatttagacataatcgtatccgtctttaaaagcggtacgttgctttttcctcccatgatccggagattgatggaccaaagcccgatctgcgtcagaattccggccagaatcgcgggtatttcaaagattgtatgtaacaatccggttaccgctccggccgccatcccggctatggccgccatccccaaggcaacccagggatcgacattaaaattcaatatcatgacggcgcatacacagccgcccattgcaaaactaccatctaccgtcaaatcggcaatatctaacagtttataggtgatgtaaacacctaaaaccataatcccccataaaactccctgaacaactgcatcctgaagggatatcagtaaaccactcatctatcattcctccgcatattttctcatttcatatttcctgcccatgtacttggggcataaaggtatgccagaaaggcgttcatatttcctgcccatgtacttggggcgtaaagtatacccgtagggcgatcataggcataaatgccttacataaaaaatgaaagccccattctttatgtaaagcatctatggttgacaggcgggccagtcaaataggcgccgcctgccgctcattcctgtttaaatctgcctatttaaggctggaaacatcgatcccaagggtctttgctgtttcctcgttgacagtcagcttgcacttatccaaaggaagatactcaataggcatcttggagatgtccgcaccctctgttaatatcttcactgcctgctgaccggttaagtaacccagttcataataatcaattccgtaagtagcaagaccgcctgcatttaccatgccttcttcgccgcagattaccgggattttgttttcaatggctaccatgctcactgttgccatacctgctgcaacagtattatcggttggcgcatagatggcatctaccttgcctaccatggaggtaactactgtctggatctcgttggaattggatacggtgtaatccactgcagtcatgccttccgcttcaatggcatcttttgccatcttggcctggatctctgagttggattctgaagaacagtaaaggattcctacagtcttagcatcggggagaatcttctttaacagggagatctgctccttcacaggggtcaaatcagaggtaccgctgacatttccgcccggattatcgttgctttccaccaaatccgaagatgcaggatcagtgaccgctgtcaccagaaccgggatatcgctcgtagctcctgccacggcctgagccgccggtgttgcgatggcgagaatcaaatcgtctttatcattgaccagcttgctggcaatggtctgacaggtaggctggtcgccggatgcattctgctggtcaacggtatagttaagacctgcatcgtcaagggcctggataaagcccttattggaggcatccagggctgcatgctgcacaagctgaagaaccccgattttaaactgctttccgtctgcagtcttttctgctgtggattccgccgcttcacttgtattctctgctgctgtggtggtttccggtgccgcagtagtagtttccggagctttacttccgcatgctgtcatggacatcatcatggcgccggcgagaaccagtgataatacttttgctgatttcttcataatcttctctcctcttccttccaaaatctcgtcctttctggaacttaattcgtatcatactacaaaaaagacaagccgtcaattttattactttaattttatatgtttttaaagcgttaaagtacattttcgtcaaaatttacgataaaaatcccatatagtccatttcattcgtcaaaaagaccggagaatctctgttctccggtcttttttaattggcaagaaatccctttcctataatctcactggaattggatatcagtataaatgcagtgggttccacggtacgtatatagtttttaagtttcagcgcctgggaacgtttcatggttgttaatatgacggtctttttatgatggctgaaagctccctgtgcctcgtaaactgtggcgctccggttaagcacgtgaatgatgtaatcacaaatgggcaccgggtcatcacagatgatactgaagcatttgcaaaggttgatattctcaatgacatcgccaatgacaagagatttggccattaagccaagggatgagaataatccggtctccggtccgaatacaaagtatgccagtattacacccgccacatccaccagcagaagcactgtacctatattaaggctggtgtaccgtttcaggatcattgcaataatatccgtccctccgctggaagcccccacgttaaaaagaatggcagagccaacgcttggtaaaaggatggcaaagatcaattccaaaagcggttccgtagtcagcggcctagtcatgggatacagccgttctaaaaaatagagtgatgctgacatcataatggtggcgtaaactgttttgattccaaaactccgccccagaaacagaaagccggctaccaaaagagccgtgttcacgatattcgtaaactcactggccgaccaatgggtcaatgcactgattactgttgcaaaccctgtgacacctccgaatgcaaaattattagggaatttgaaaaaatagattcccaccaccataatccagatgctgaacgtgatcagtccatactctgtaagcgttctcagtgttttgttttctaactgcttcatggctgtttgtctgtccccctccggctccttttagccggttccgtatgtttatggaatgaatttaaaacttcctttcactcccactcgaatatacctcaaagaggcggtaattacaaacaccaatccatctgatattctcacagtctttctattgtgaacaaggggtaaatcccacgtctgcaaggaaccgtgcaaatcccttccgtccaagctcatcacatttataaacgccggaatcctccaacacccgttcaaataccagaccaacttccttctttaaaatatcctccacattttcctttgtcactgcttcataattttttaaaaaagcctccgcccagtccgcgtgtttttcaatggcttcctgttctcttatgttctttccttccacaatacattcagccaggagattcagctcttccttcagcctggaaggcagaaccgccaatcccatgacctcaattaagccgatattttccttcttaatgtgatgaagctcctgatggggatggtaaacgccaagaggaaattcttccgtggtgatattgtttcttaaaaccaggtccagctcatatacgccatcccgcattctggcaatgggggtaatggtgttgtgaggctctccgtctgtttcagcaaagacaaagaattcctcgtccgtataagccctccaggcattaagaacctttgttccaagtgcgattaaatcttctggatttttgcttctggtacgcagtacggacatgggccatttcacgattccggcttccacattgtcgaagccttctatccggaaacagctctccattggagcctttgccatggcaaaatcataatttcctccctgaaaatggtcatgggaaagaatggaacctcctacaatgggcagatccgcattggagccaagaaaataatgaggaaacagttttacaaaatcaaacagttttacaaaggtctctctctctatcttcatgggaatatgctgtccgttgaaaacgatgcagtgttcattatagtaaacgtaggggaatactgaaagccccactggctgttgttgatctcaagacggatgatcctgtggttatttctggcaggatggtttgtccttcctgcatagccctcattctccatgcaaagctggcatttgggataaccgctttgttttgcatgctttgccgctgcaatggccttcggatccttctcaggctttgataagtttaccgtaatgtccagttctccgtatttggtaggggtcacccaacgcatatcctttttgatccggtaccgtctgatataatcggaatcctggctcagcttataataatatccggtcgctgcctgggggactggctttggtacagctcccagaacgtctttcctatttcgctgggtcttggcatcaggcagttcatcagctttgtatcaaataaatcccggtatgtaacactgtcttcctctatgattccggtctggcaggcataatcaagcaattccttcaaaacagcttccagctctatttccccgcattctcccggctgttcctcatactcgtccatcatcatcacgtcaaggatctggttaagggcataaaaccggtcctcttcctcgatcaagcctgtgttaagtccatactgcaccagtttcttaattgcctcatcaatcattgtggtatccctcctggtttctttttctccgtatattctatctcattatacctttcccaaagctgcaaaacaatacgatttattttgtttttactgcattttttttataaaaccactgatccggtttatgatcatgcctcccagaatccctatgacaagtcctgcggccgtaccggagatcagaagcatggggagataaaagaacactccggcctgcttgaccacaagggcggccacgcagacttgtccgatgttatgtcccacacctcccagaatactgatgcccgttgtgccgatccagtttttcttcctgcaaaggaccatgataagaaggcttaagctccagcctcccaggctgtagagcatggcaaacaggttcccaaaggtgaagccggtgagaacgatccgcaaaagcgagatgataaccgtaccgcctgctccgaccgtatagagccccacaaccgtgaccagattggcgagtcccagctttactcccggtatcccaagggaaatggggatgagggtttctacaaagctgagcacaaacgccagtgcaatcagcatcccgtacaacgctgccacatgtgccgaattttttcccttcataagagctctccttttttctgcaatcagcctttatcttatcacattttgtcatttatgtaaaagaaaatcccggagaacatcctaataattaggaaaaccctctccgggataaaacctttaattgattcttttcctggtctaatccattcgtttatcgccccagaaaaacagtgcaacagtaccaggtccggtatgggagccgatgacagcgccaatgctgtttaacaccacatttccggataaaccggggaagcgttcttctaccagggcggccacttctctggcgtcgttttcacaggcggaataagaaatgaagcattttccgttgtaatcccttccgccctttgcatgggcctccatggtatttacgatctcctggatggcctttttcttggtacggatcttctgtcttggaatcaaatgccccttgtcatcaatgctcataagagggcagatgttaagaaccgttccaagcattgcagaggtagctgaaatcctgccgccccgcttaaagctggttaagtcggtggaaaaaaaccagtgatgtacaaataatttgttattctccgtccattcccaggcttcctccagggaaacgcctttgtcccttaagtctgccactgcctcagtcaaaagtccatagccggcagaagcggccagggaatctacaacaatgatctttctttccgggtatctggaactcatctcttctctggccacacatgcggaattataggttcctgatatgccggaagaaagggtgaggtgcagaatatccttgccttcctttaaaaacggttcaaaaaaattacaatattcttccacattgacctgtgaagtcaccggtgttgcgcctttggcgatccggtcataaaattccggaaagggaatgctctgccctaaatcatccggataagtaacgccatccattgtatagtgaaaacacacatagggaatctgacgctgctcaaaaaactccttcttcctgtctaccgttgaacagcaggttaaaataaaacttcccatatctgtacacctcctatcatttgctgaatcaatattaacacattttttcctgaattggaatctttacgacaaattccgtccccacatcaagctctgagcggacggtaatggtcccatgatagaaatttacaatatgctttacaatggaaagtccaaggccggttcctccctgctttttgctccgccctttgtccacccggtaaaagcgctcaaaaatacggcttaaagattcttttggaatgcccattccattatcctttacgcggattaacacattgcggtcctcttctgtcacagtgacccacacctggccaccgggcttgttgtactttaccgcattgcttatgagattcccgaaaagctctttcatctgctgcccattggcatagatgcaaagaggcttgcagtccacatggatgatgacttcatgagacgccaccaaaggctttaaggattccacgatatcgtttaaaagaatggacaggcgcacatcgctttttaaaacctctgcttcctttgcttccagccgggagatcattagaatgtcattgatgagatgattcatattgaccgcttcctttttgatgcgtcttatgaaatccatcttttgttcttcatcctggatgatcccgctttccagaagctccgcatatccctgaaccgatgtgattggggttttcagctcatgagaggcattgctgaaaaattcctgacggatctgcttttccagctcgatctggtttaaatattcctttatattcgtagacattgacctggtcgtttctgcgataatattaatttccggatattggtaggtttcaaaggaaagatcagtgtaatctccgtttactttcagcatctcctgagaaatttcctttaacggctttgttatggatttagaaaagctgtctgcagaaaaggcggaatacatgatggccaagagaaagctgagccagatggcaggtaacaggagcattaaatattctttcattccggaatagggaatggccatacgaagaatataatccgcctgtgaggaacggatggcaacatacagcatgttttctttaagagtctctgaataacgcctggccgtgccggccccctctgcaagagcctccttcacttcttccctgtctaaatgattatccagggaagcagccggtacatttccagtatcggccgcaacacttccatccatgcgtatgattgtaaatcggctttgattttcggtgagtgtctgcttaagatcctctatctctccgtcaagattgccggaataatccagaatctcatccatggcctttagagtgtaggtcatatcctttctggaatttttaagcaatgcgctgctggaggcaatataaaaaacagcactactgagtatcagcacaaccagaatgatctggataaatttcttaaagatcacacttctcatagactcctccattctgcacatatgcagccaggtcatagaattccttactcttctgccttaataaaacggtagcccacacctcggatcgtcttgatgcaggaacctccgttttctcccagcttttgccggagagtacggatatgcatgtccagggtcctggtttctccatcgtaatcatatccccagatgtggtttaaaagctcatctctggtgacgaccttattatgattttccattaaatactgtaaaagatcaaactcctttaaggtcagttccaccttaacgccgtcacagtggacttctcttgtttttttgttgagactcaggcagtactggttcagttcatttgctgaagcctggtctctggtgctgcggcgcagaaggcttcggattctggctgccagctccataactccaaagggctttgtcatataatcgtcggctccgccatccagtcctgccaccttatcaaattccctgtcttttgctgtcaggataagaacaggaatatcttttaaagactcatttttacgtattcttcggatagctgtcagtccgtccatgccgggaagcatcagatcaaacacagccagcgccggcttatctgcttcaatgtgctttaaggcatcctccgccatctcaaaagcagaaacttcatagccaaaaccttccagagcaatttttattaaatctctgatgttgtcatcgtcttcaattacatagataagttccatacagtctcctttccattttcctgccgtcttctgttacatttcatccctcacataaccggcaatattatgagcatggtctgaaatacgttccaggttgctcagcgcatccaaaaagacgactccgttttccggtttacaggtctgagcagataaacgctcaatatggcgttctcttaattcctcttccaggctgtccactcgttcctcgctctgaaccactgcacggacctcagacatgtcggaagttgcccttgcctttattgcatgctccagagaggaccgtacttctttgatcatttccttgatctcattttctgcttcctttgagaaaacaatgttccggttggctttttcaaccgcaagctcagataagttctcacagtgatcactgaccctttcaaaatcgctgaccgtatagaacagattttttaccagaagatgctgttcttcatttaaagactgattgttgattttcaccagataatcaataagtattttctcataaccgttgatcttctgttccattttttccaccagctttgcctctgctttatcgctgctgagaagagctgccgctgcaagatctaagttctccatggcagcataacccatgttcaccacctcatggtttacgttttcaattgcaaaggaaggggtttccaggattctgtcatccagatgacgtttcatctgagcatcggaatccatggaagcttccttcttatcttcccggacaaggattcccgaggcctttaccaaaagtcctgcaaaggggaataaaatgacggtattgctcacattgaatatggtatggaaaatggatattcccacgctgctgatccgtgaagccgcgaaaaccggattcagcgtaaatacgacaaacatgatgcagccgaagatcacagcgccggtcacattaaaaagcaggtggatgacagcggcacgctttgcggttttatttgctcctatgctggaaagcagggcagtaacacaggtgccgatattttgtcctaaggtgatgaaaatcgctgactgccagtttacgattccattgagcgccagggtctgcaaaattcccacagatgccgaagagctctgaataatgccggtaaccacaagacctgctaaaattccaagaaacggatttttccccaaaatagaaaatgcctggctgaaaataggagcattccggtaaggagtgatggagtctgacataaatgtaagtcctacaaacagcacaccaaagccgactaaaatttctccgatctgctttttctttccgctgccagtaaaaaggcttaaaacagcgcccacaccaatcagtgccggagcaaaaaactcaggtttaagcatttcgccccattcgctcatggatacgatccagctggtaacggtggttcctatattggcgcccataatgatacccacggcctgggccagattaatgatcccggcgttaacaaagccaactaccataactgtggtggccgagctgctctggatgatggcggtaattcctgttcccaaaagcacacccatgagccggttgctggtcagaactcctaaaagctgctgcatcttatggcctgcggacttttgaagcccatcggccatggcatccattccatagaggaacatccccagtcctccaatgaatttaaatagcatttgtatatctgcgattgacatagcttcctcctgatttttcatgataagacatgttatgtaagtactatatcaaatctatgtaaagtaagatgcacataaatgtaaaatttatgtaaatttttgtcttaatgtaaaatttccttatagacccgaaggacattcccataaaagaccgcttctatttcgctttctgagaatccctcttttttcatataaccttccagaaggggcagatcttctgaagatctcagctctaaatttcctccgatcccatcaaaatccgatccaaggccaatgcactggatgcctcccacctgcttcatatgcttcatatggaatatcatatcttccagccggcttaaaactccatctccctttttccagtcatgaagaaaatcggcgcaataattgatcccggccacaccgccccgttctgaaagccttttgatcatatcatccgttaaattcctgggatgggaagcaatggtcctggcgttggaatggctggctacaaatggcttttccgtatagcggaacacatcttcaattccggcatctgacaaatgggacacatcgatgatcattcccagcttttccatctcctgaataaaagcgatccctttttccgtaagacccagctcaatttccggctggaaaaaggcctctcctttttcctcccagaaccggtttggatgccccagttcgtttttataattccaggtaagagtggccatacggactcccaaccggtaaaaattccttaaaaatgccagttctccctggcagacgcctccctcctctatggtgagcatggcagacatcttcccatttctccggttttcttcaatgtcttcgtaagtttttacaatgccgatcatatcctcgtatttttccagctccgtaaaaaaaaggtcagccagcttcatacaatattcaaagggatgttcctgtcttgcaagatttgtaaacatggcaaagttctgcaggcagtaatccccctttttcatgcgctccaaatcaatatggcagtcattctttaagatagaatactcctttccctcctccctgcggtaaaaaagctcggaaatcgtatcacaatgcatatcaacaaccttcataatttctttcctttctcatgatccttctaaatttcctcgacgcaaaaggagcaacccaaaaaatgagctactcctttggtaactatgcaaatagtatcaccaatatgtcatatttgcaagaatttgcaggaaaatatcggattatcactcactgcgcagggcgtcaatgggatttaaatcagctgcccttctggcaggcatgtagccgaacaaaaggccgatccctacggatacactgaaggaaactaccacggcgccgggtgttggggtggcattcatccccatagctgttccaatgacggtcgttgccacagagcctatcaagatgccggcaactccgccgagagaactggtaactgcggcttctattacaaactgctgcatgatgttgcgtttttttgcacccaaagcttttcggatcccgatctccctggtccgctctgttaccgacaccagcatgatgttcatgacccccactccggctaccagcagcgagatccccgcgattccgccaagcatcatggacatcatggagatcatggaatttaaggaatccaaaagctcactcatggctgtgatccggaataagtcctcatcctttaagatctcaaaaagaaaggtgttaatcgcttcctttgcctctgtggtatgatccatatcagcagttgcaaatacatagctgtttatgtcggcagtgttattcatcttggcagcactgctgtaggggagatataaaacgtcgtccgagccgccggccttaagttccgaatcatcctgtctggaaaccacgccaatgatctggtaagcataaccgtttattttaatagtctggccaatggctttttccgctcctccgtataattcccaggcaacataataacctgccacacagaccttttgtctggatagaatatcggaatactgaagaaaccgccctgaatccagagtctgatccttcatttctaagtattcctcgctgacgccggataccgtggtatttgtcagggactccgtcccgttttttaaagtagaggataaggaaacccttggcgtcatctgggcaaaaaggctcctgttgtcctcataaaattcatacatctgatcaacggtgacggacctggatgaaagattggtcacgttgacgttgatctggttggtacccatgctggcaaagctttctgtcatataggacatctgcccgtttacaaggcttaccagaatgatgaccgatgccacgccgatgatgatacccagcatggtgagaaaggaacgcatcttatttccccagatgctttttaaagccattttaaaggattgcagaatattcatttacgtctccatcgaaattaatcttaccatcgtgtacccggatcacccgcctggcctcccgtgcaatggcgctgtcatgggtgatcatgacaatggtattcccttcatcgttcagcttttttaagaaattgagaacttcccggctggttttggaatccagagccccagtcggttcatcggccagaatcagagagggatctcctgccagcgcccttgcaatggaggccctttgctgctggcctccggaaagctgattgggaaagtttttccatttttctgccaggcctacccgctctaaggaggccatggcccggttgttccgttcagcggctcctatccctgaatacagcaggggcaattccacattttcaagaagattcagtctgggaagcagattatactgctgaaagataaagccaatcatcttattccgtatcccggccagctgattgtccgacatccttcccacatcctcgccgcccagaagatactctcctgaggtgggaacatccagtgcgcctatgatgttcatgagcgtggattttccgcttcccgactttcctacgatagccacgaattctccccggcagatggttagggaaactccgttgtttgcccggacctcctcctcccccatctggtatactttataaatatcctttaattcaatcaaagaattttccacgctttacaacctccttgctgccttttgggccgagggccgccgctgctgccgggccctcagcctccggtgtttcagccgccgttgcgccttgcaccgccggaattacccccggaattaccgccagaaccacttccggaaccgccgctgcgccatctgccatcagagccgcctcctcccggatttacatttacgccgcccatgccgcctggcatcataacagcgttggtgttgcttacagtggtttgtgcaacataaacttcctggttttcttccagcccgcttttaatctccacgtaattatcattgatcagtcctgtggtgacttctatggctttaaagcctgccggtatgtttccctgggcctctttcactgtttcatcctttacataaacctgatttccccgcatcagtgcatctgccggaacagccagcacatcggttgctttgtccagaatgatcactccgtctacgttcatgccgggaagaagctcatccattccgtcatttaaggtaacggtaaccggataattggtaacgccgtttgaagtggaactttccaggctcacattggtaacaatgccggaaaaggttttacctgttaccgcatccgctgtaactgttacctcctggccaactttcacggacttgacatccagttcatccacagacattttaaaggtatagccggacatatcgtatatgactgccagggtcgtacttccgctggagcttttggtgatcttatctcctgcctttacggatttagtaatgaccttcccggatatggggcagtaatggtatagttatcataggtgtcgctggtgctctccagcttgctcttagccgattccagggtctcctgagccttttccatggtatctttataagttcgtatcagcttatctgcggacctgctttccattgtaaagataggagtgccctttgccacataatccccttcatggaccagcagagttcccacctccacattggaagataagtctgctttcatggtcgtctcaagttttggctcaaaggttgattccacggtacatacgtaatcgcccaccgatgctgtggccggggtctccgtagtaaggcctcctggattttccacttcaatggtaacgtagcggacgatccgtccgcctgttaaagtcacatccatattgctgacagaggagacaacgccttgaatctgttctcccgtatccgtaagggtcagaattgctccctggccggccgttatctgagcagcttcaccggaaagaaagggaaccttgatcttcatggttttatcatcgtagatggaggcaatttccgtattgttccccactttatccccttccttaatggaaagagattttatgtacccgctctccgtggacttgtaggtattcccgctgtaatcacttaaagcagcattataatcatcctgagcggctttataattttcctcagccctggccagggagttgtttacggaggtcatctccgattccatggaggaggtgtcgatctgatagaggatctgtcccttttccacctcatctccctcttcaaaatctgctgcaattacttctccttcaaccagagaagtaatttcatatgtattcagaggggaaatggtgccggaggaagacagttccgaaacaatgtcctgctttgttacccttgctgttttgacgctctttgccgcagctgagacttcctttgactttttatagctcactgttcctatggctcctgccagaactgcaagaattacaatcaaaaggatcaggatctttttcccctttatccggccctttcttttttctcttgaaaataatttctgaatgacttttttcattccggattctcctgttaatcttctatataatcaatgacagtcctggtttcatttccttcattgtccacagaaagggtatagaccagattcacggtatccccgactctcaggcctccgtaggaagaaaatacaaacttcatttcagtgctggaaagctcataggtattgccgtcatccagtatgatcgcccccggagtcattaagtcagtagaatcatagaccacgttggtgatttctccgaatacggcggaacggccgttttcattttcatttccaacggtataaagccatacggttttggagagggaatgataataaaccagaactccgtccgagctttctagggaaacggtaattgcatcactggaattggaaacagcctctccgtcaagataaacattggcctcccccagcttaaagggaaggagggaattaagcctgcttttgcttcttacgatcttcggccccttaaggctgttgtcaaccattgtaaatggattgatctcaccgtcatctgtcaattcacagtctaagctctttccaaacatggttccggattttgtatcagtttttaagagattataaaacaggttgatgcaatcctctttattcatgatctccaaggcctctttattaagattctcatctaattccaggaaatgatatttggaaagcctggaaccggactggtcacctgtaaaatcggaatttacatattccaaaagtgccagaactccttttaccgcctcctgaagggttatggattcgtccggcttaaagtttcctcccagatatccgttcatccacccctgctccgctgcaatccgtatctgggccgcatattcatgatttctcggcacatccgcgaatacggaagtattgctggttttgcctgctgtacttcgataggaggaagcattgaccagcatactggcaaattctccccgtgtcactgccagacccagattcccggtgttcatgatccccgaaaccccaatcaccttttttcttaagtcaaaattacttgatgcctccgttatcatagggctgactgcagtcgcagccattacaaaagccagggaggccgccattcttcgtccgttcatccagtttctcctctcatcattcaaatctgtagcttattttagcaggccgatatgtccattctatgacagtaagctgaaattaacctgaaactctgtaatttcagcctattttaagcttgatcccttatgattgaaataactgagaaagcttgcttaataagcggtctcaacttataatagatgataaccggttcataataaaggatataggagaatctaattatgaaagtgctgattgtagaagatgaagtaaggctggccgatgcgttgggacagattatgagggaacagcattatcaggctgatattgtatataatggaaccgacggtttatcctgcggcctttccggagaatatgacgtcattgttttagatgttatgcttccgggagaaaccggttttcaggtggtaaaaaagctgagagaagcccgcattcagactccggttctcatgctgaccgcacgggatgacatccgggataaggtgaccgggcttgataaaggggctgacgactatatgacaaagccttttattccggaagaattgttggcccgcatccgtgctatctcccgccgccagggtgaagtgatcgtagaggaaatgaaattcggagacctggctttaaatttatccgccaatgatttatgctgcggcacaaaatccattcaccttgggtataaagaatttgaagtgctgaaaatccttatgggaaattccggcaggatcgtttcaaaggaattcctcatttcaagggtatggggcagtgattctgacgcagaggataataatgtggaagcttatatttcctttctgcgtaaaaagcttaattttgtgggatcaaaggtcgaaatcagtaccgtccgtaaggttggataccgcctggaggaacggttatgataaaaaagttaagaataagatttgttttgatcaacatgacctttgtcattagcattctttccgtagttcttggcattttttactatgcaaattacaaacgcatcgagcggcagaccgtcatggccctgctgcaggtcatcgaccatgaccgccaggagcggccgccggataaggtggaattcggccgcagaccccaaaaggacctgcctcctctcatacctgttttcgtggtgaccgtaaacaatcgtaattccatagaaaccataaaggaaaacaacatcaccgtcacaaaagagcaggcctccactctggtaaagttagtaaaggccggcggttctccccagggagagcttaaggattattcccttcgctatcttaagatttccgcaatggaaggaattaaaatagggtttgcagatcaaagctatgaacggaataatttaagggctttgctcattaactgtctgctggtcttccttggggcaacttttctttttttgatcctaagcctgtttctttcccgtctggccttaatacctgtggaaaacgcatggcgggtgcaaaaccagttcattgccgatgcttcccatgaattaaagacacccctcaccgtgatcctggccaacctacagattctgtcccttcataaagaatgcaccatcatggaacagcaaaaatggctgaataatacgaaagaagaggcccaacggatgaaacagcttgtggaagaattgctctttttggcccgttccgatgccgaatccgttcaggcgcctcaaaccgcaaaggctcctctggatttcagcgatattgtattgaacggagtcctgctgtttgaatctgtggcctttgaaaataaggtggatttaaaaaatgagattgaacccggcattttcctggaaggctgggaagcccagctaaggcagctgaccaccatcctcctggataacgcctgcaaatatgcgggaaaacagggttccgtgtccgtaatcttaaaaaaatctccccattatgctgttttgaccatccaaaatacaggagaacccattcctgaaaaagaacagtcccacgtttttgaacgtttttacaggacagataaatcaagagttcgcaaggaagggggatatgggcttggcctttccattgcaaagaccatcgttgatcagcataagggaaaaataagcctgaccagcagccttgaggcagggacctcttttattgtcagcctgcccctcccttcccgtcagtctttaggcaaagcataaatataggaagggcgtaattgggaatctctccaattacgcccttccttcctttatttattttgagacagagatcccatgatcctcaattctctttctgattcccagcatccgttcgtcggtctgagcgatcacatccgcacattcccgcagttcttcgctgatttcctgggaatactcttccacttctttcttatattttagctggtggtctaagctggcccagaaatccatggcaatggtacggatctggacctcggctctcatccattttttctggtcagagaagaaaaccggaatctccacgatcatatgatagctgcggtacccgttttttttcggttgccggatataatccttaatggcaatgatatgcacatcatcctgtctggccagcatctctgccaccgcataaatatcatccagaaaggaacagatcacacggattcccgccacatcatctaagttgtccatcatggattccatggaaacaggcagtcctctccgctgaagcttttctacaatactcacaggctttttgactctggacttgaccagctcaatggggtttctggaatttctcaccgacagttcgtcgtttaagacctccagttttgttttgatctcccggatcgcacaggtatacatcatcatagcttcctgaaactggtatgcctgcttgataagcggatccggaacctgaaccagattgggaacattcacaatggactggttcaattcactattggggttcatgctaatattcattcttatccctcgaaacgtaaattacttatgctttttctgctgccacaaccgccttgtcaagccaggtcgcttctaaatactcgatggtaccttcatccactgctgctgcaatccttgggtcaatgggtatcttagccagtacggtaaggccattgttttttgcagcttcatcaacacggctctctccaaatacagagatctgttttccgcagtccggacagaccaggtaactcatgttctccacaaggcccagaatgggtatattcatcttttttgccatatttactgctttttcaacaatcatggtaacaagctcctggggagaggtcacaataatgattccatccacaggaagggactggaacacggtcaggggcacatctcctgttccaggcggcatgtccacaaacatgtagtcaatattctcccaaagggcttcctgccagaactgcttgactgctcctgcaatgacagggcctctccagatgaccggatccgtctcatggtccaggattaaatttgccgacatcacttcaattcccgttgcagtagtagccgggatcatgagaccgttcggcgtcatgcccacaccataatcagaaaggccaaatgcttttggtatggatggaccggtaatatccgcatccagaatggctgttttatatccctggcattcatgcccacagccatcatggaagtcaccagagattttcctacaccgccctttccgcttacaacgccgattaccttttttactgtactggcagggttaaggggctctaaaaagcttaccggctcctcccggctgctgcagctctcaccacaggtattacaattatgagtacaatttacttcactcatggatcattcctcctaatgaattataatctaatatatggaaaacagctttttttaagccgtctgcttctatagaatccgtaatgtatccggccgcttccttgaccgtgtcagatgcatttcccatggcaatcccaagacctgcaccagttatcatggaaatatcgttcgtgccgtctccaatggcagccatctcatgggcagagaatccataatgtgccgacatcttcatgattcccctccatttgcttccgcctgccggaatcacgtcacaggccatctcgtcgtgccatcgtatgaactcacagccaacaagatgctttctcagcttactttccatgtcataggaaacgtaagggataatctggtaaatgcgctggcttctggcccgttccacatttaaaacctgcggaatcctggtcccgatttccaactggaccttctctaccatggaattcaccatattgatgtacatgcagtccccttccataaacagacagggaaacggctcctcctctaagagtgtcaaagttttgtcaacttcaacaggatcaatgggaaaatcataaataactctttccccgcaatagcaatactggccgtttaatgtcacatagccgtcaaaggggattccctccaaaagatcttcctcttccatttcaagcttatggcgtcctgtggcaataaacagaaggatccctgcctttctggcttccaaaagcgcttcttttgtgctgtccggaatccttcctgtctggaaatccctcagcgtaccgtcaatatcaaaaaaaatggcttttatccgcctttccattttccatcattccttctttaactgattattcttacctgcctgaccttacaaacacttaagattatattataacttatctgaacttgcaacgcaagtgaagataaaagggctgtttttcagcccgtccatccgatgatgaacaaaggcctgtgccgtcatttccgacgctacaggcctttgttcattattcccgtgaagtcaacgagccaatgtcagaaaagcttaactttgacggctgcccacggacccagataccctatcgcttgctacagggtatttgattttgttcctgcagttccggctctgcgaatggtcttaaatacccccatagtatccagggcttttaccatggtataaaaaatcatggaatcaatgggccacataaccaggtttttaaacgcccttgccgggagaagcaccataaacccctttccgtacaggatggaaagacacatggtattaaggatcacgttgcagaccagcatgacaagaaacttggagatcaggaccctttttaaggtaacaggctttctgtaatacatacagccatacataatacctgccaaaacagtaaccagagtcagccccgggaaaaatgcacccgtaggctttaacaagtatttaagcacatccatgcttccggaaaacagacctcctactaccggaccaaacagatacgaaacgattccgtttggaatggaagaaaaactgatccggatgtaatttcccatgttaatggaaaacatgcctaagacaattgctactgcgccaaacatggcagacgtggtgatggtacttacagatttcagttctctgtaagaatcggtgaacaaagtgacgaattttttcataaaaaatacctcctttgcagacctcaaactacaaccggagatattattcctatcttctgatgcagcgggatgcgaccggtgtaccgcaagaaaatcttttcgtccagctgacaactccctgttcagccggcacttaacgcacacgggtctactctgcgatttataatattgtattttgtaacgccatcagtatatcacagattccagggaaagcaagtattttttttagaaattcctcctctctccaccgcccagtgaaccagaacagcgattaaaatgcccagaaacagccctcccagcacatcagtcgggaaatggacaaacagatacagcctggaaaaactgatgagcactgccagaaccagagaggcagttccccatttccggttataaagccagatgctcacggctccttcaaaggaagccagggtatgcccggaagggaaagaataatcctttgggttcctgatcagaagggggatactggtatcaatccaacagggccgttctcttgcaaccagattcttaagaatcatatttcccatcaaaaatccgactgccagggacaaaataacgcagaaacccgcgactcttgtctttttaaagcacagtaaaacaatgccggtaatgatccaaaaaattccgctgtcacccagaccggttatctccttcataaacacatccagccagggagtatgtaatgattgtaaaaaatataaaatgccaaattctatgccagccattatgcttctttgctccttttttattcatgctcttattatatcctgaagcccttaatttgccaataaaaaatagatcatattaataaaaccatttgacaagacacgcaattaagtttaggataaaccatagttgaaaaccaggaaggaaactaaggaggctttgtaatgaaatacatcagacaattcactattattcttttcatatccctggccggagagatcatacacctgtttattccccttccggtgcctgcaagcatttatggtctgctgatcatgctgattgggttaaaaaaacgatggatcccattggaagcagttgaggacgccagcatatttcttattgatatcatgccattgatgtttattccggcagccgtcggacttttggattcctggggagtccttcggcctattttaatcccatttctggtgatcaacctggtttccacggtcatcgtcatggtgatcaccggaaaggtgactcagtttttcataaaaaacgacagtaacagaaaggcagaaaaaaatgagtaatgcagtaagtgattttttgttttttggcgcagtgctgagcctgttaggctatgaagttggactccgtttgaagaaacgattcaaatgggcccttttcaatcctcttttgatatccatttgcattgtcatggcatttttatccgcatttcatattgattatgaggtgtacaacaaaagcgccaattacatcagctatcttctgaccccggctaccatttgcctggcagtcccctttaccgccagctggagctgcttaagaagcattccagagccattatagccgggaccctgaccggagttctgtccacaatgtccaccgtactgcttctggcccttatctttggtttaaatcaccaggagtacgttacctttttgcctaaatccattaccactgccattgcaatgggcatttcagaagaaatgaagggatatgtgaccattacggttgccagcattattgtcaccggaatccagggaagcatcattgcggaagccgtatgcagagcatttaaaattacggagccaattgccaaaggcattgccattggttccgcctcccatgccatggggaccacgaaagccatggaaatgggggaaatcgaaggagccatgagcagccttgccattgcaacctccggattatgcaccgttatatttgcttccgtgttctctaatttcttataagcaaaatacaggcacttatgatattgaatacgacttatgtccaggcggggaatcaggtaaatacaggtgatttgccggttaattctggtttgagaaaatcggggaagaaagattgccggaacgattccggtctgtaaaaccctgaatcattccggcaatcgccgtttctttcttctaatctcctatagcagccataagatttcttccaggccaaagcttttatcagaacggaatattttctccagttcattgagattctcatccgaatgctccacctctctggaaaaccagtgggccaaatgaacaaattccttaaaatccagcctgccttcatttcttttaaaagctgcctgagccatttcctgaatgagaagggtgctcactgccgcaagctttgtctttgcatagggatggccgtcataaacggctccgcagaaataggtaaagataaagtacaccataagctgttcgctccaccgctcccattggcgtttcctgccctcttcttccattaaataccggtcaaatgcctttctgttttcctcatagctttccgctccggcatcaaataatatctttttaaggctccccatgtattgaggccagtcctgattaagcacttcaagctttccaaagagagaaaaccattccttcattttttcataccgcatcctgccgctcaacctgcggacagccatcttcttttccgcaagctccgctccggccgctccctgataccgctccatcaaatcatccaactgagaaagcttttcctggcggatcctcctttgcatatcatgagaaaaacccaacgccatagcaatgcgcagacggcagtctatatcccggttctgcaggatagaaaccatcagttcccttgcatccataagctttgtaaagaaaaagatatcaaaatccaggtaggactcctctctctcatcttcctttgtaagaaagcgtacaggctcttcacagccaaggatcagccctgccgcctcttcgcaggacaatgacaaggagatttccctgactccttcatattcctccgtatgccttggataatcccggcaggttttgcaaagcattcccggcccggcctcccggtagatatcacatagattgtcctcatttaaaaaggcacaccggcggccgcactgcttaaaggagccatttttccagtcaatagaatgatggagcctcctgccgaaggcatctttttgcagccgataccgcttttttgtgagatcatcgatcataatggcccagcctgcacagcaggtatccggacacttccctgccacacagcggaatttattataataatgtggaatagtaaactgcataaatgattgctcctgttttttgataacgattatacctcatttaaaaatggggtgcaacccatttaaaagagcgtcaccccattttccatcagctggtcacaacttcccaaatgccaggaacaaaaacagtatgccgctgacccaggttaaatcccagccctttagtgcagcaagcttacgtcccagaaacaggcccatgtacatgacggcagttcccacaaccagagcggtaagtgccgtaagccccggagatatcatcaagaatcctgacaaggctccggctaccagactgtccaaagacatggccagagaaaacatgatggtttccttccaggaaagggatttggaatggtcccagtccgctgccatgggatttccgtaaatatttatgatgatgctcagtcctgaaatagaaaacgtcagatccttgtgaatattcacatggctgttgatatatttttttatggtataatccagaagctttattactcccagaagaaacaggcaggaaaatgccgctccctttgcaaaactttccggcaccaatccgctgatcatgcttcctaatactagggcagcccccaggcagccgctgcagatcccattgaccgcaatcacctttccccacgaaatcttcagacggtttgccccataggcaatgctggcaacaaaggtgtcggtgctaagtgccagcacaagaatcaatatatcacgcatatcctgtcgaacttacctttttattttaatatattcacccaagtctcttttggccccctaaagagcatgggatttttaaagcctcactccttttactctttgtcccctgttccatctgcatactaaaaagactgaaaaagcaggggcatcaacacgcccctgcttttatgttcattcatttacctgcgcagcttattaaattcatctgccacaaactgcacctgaggtcctacgatgacctgtacgctggtcttgcccggtctgatgacacctgcaacacctgaagatttgatcttcttttcgtccaccagagtataatccttgatctcaagtctcaatcttgtgatacagttatcaacgctggtgatgttctccttaccgccaagtccttccagaatgatggcagcaacagcggtatagttattattggagagagtgattgtgttttcatccatatcatcatcttcccgtcccggagtcttaaagttaaactttaagattgcaaagcggaatacgaagtagtaaatagccgcataaacaaggcccagcgggataataagcagcggatttacagccattggagccttaaagctcaagaaccagtcaacgaaacctgcgctgaagttaaagcctgcacgtacgggaagcagggagcagattattaaagaaataccggttaaaattgcatggattaagtaaaggcctggtgcaaggaacatgaaagcgaattccagaggttctgttactcctgtaaagaaggagcatactgctgctgcaagcaataaaccataagcatttttctttttaccaggttttgcggtatgatacatagccaaagctgcggccggaagaccgaacatcattaccgggaagaaacctgtcatgtactgaccagtctggcccagaacaccatttcctgaccagaaattaccaaggtcgtttacacctgcaacgtcaaaccagaatacggaattcagtgcgtggtgaagacctaccggaatcagaagacggttgaagaaaccgtaaatacctgctcctacagcgccaaggcccaggatgcctttaccaaatgctaccagtccggaatatacaaccggccatatgaagaataaaacaaggcaggctaccagagaaacaagagcagttacaatggcaacagaccgtttgccgctgaagaatgccagggcatcgggcagcttggtgtttttaaacttattatagcagctggaaccgatgataccggacacgataccgataaactgatttccgatcttgctgaaagccggattcacttcactgacatcgatgccttttaacatgccgactacgccaggtgaaagaatggtctgaatcatcagccaggaaacgatggcagccagtgcggaagtaccctcatggtcatctgccataccaacgccaacaccgattgcaaacagaactgccatgttatcaatgatggcgcctcctgccttaatcaaaaaggctgcaacggcactgtttgctccccagccggtggggtcaatccagtaaccaatccccatcaggataccagccgcaggcaaacatgccaccggaagcatcaatgatttacctagtttttgcaaatacttcatcataataaagaaacccctttctttttgtcctgccggacatattttatccatacctgcaccatgcaggttcagatcaaattttttccaaaacggtacggatggcggttatggccgcatcctcatccgctccattaaaccggaaccggatcatactgccttctgtgactcccagccccattaatcccagaaggcttttgcagtccgctttgtctgattcccattgggcttctatgctgcaggaatactttctcgcttccatgaaaatcagggaagccggcctggcatgaagtcccatgggatcttttaattcatacaaatactccctcatttaaatacctacaattcgatgattggttccaactcttttacctgcatccctgtatgacataccatatccggataattcggcgtattgcatacgatgaccggagtgatcacttcatatccggcctcctttatggctgccatatcaaattccaaaagaagctcccctgctttcactttgtctccctgctttttataagcagtgtaatgttctccctttaaattcaccgtatcaagccccacatggacaatgatctcagcgcctcccggagtcgtaatgctgatcgcatgctttgtctcaaatactactgttaaaattccgtcagcaggtgcaacaattcttccttttgccggaataatggcaactccctttcccagaatctcctggctaaaggtgggatcattcacttcgcttaaggggacggctgttccttcaaccggtgacagaattttttccctttctttttcaccacttcccccaaaaattttctttaatgaatcaaacatacaaaaaattctcctttcatttacagcctcattcttttgatgtggaccgccagatatgcggtttcctcttctgttacatcgtgatggtacgtttccattatataatccttgatttttaaactgcacccgtattcttccggatacatctgggatatcaaatggttaaattcgccattcccgctgtctaacagctcttttgtaacgattctttgcgccaggaaccttaaatgggtgacaaaccgttgataattcaatgaagtttcgtcaggctccattgaaaaatactccttcacgatccctacggtgttctgaatcaggttcgtgatgtctatggtatcccgcatggcagtattaaattctgcattgacaatatggaacgcaatgaaccccgcctcatccactggaagggatatgccgatcctgcgctcaatcaaagcaatggcgtattcaccgatcaagtattcctctttgtaaaaggtctttatctcgttaagcagaggatttgaaaatttcatcttctccttaaagcggtgaatggcaaaattaatgtggtccgtcagcgttatgtatatgttttgattaaggctcctgtttaatacgctttttgcataattaatgatttccgtagaaacctggatgtgctcaaggggaaggttcaccagcaattctttgaatttgtcaacattgttctggctgtccagacggaatactttttcaactgtaccttccgggatactttttcccggcttcatgccaaagccgatccccctgcccatgacgataacttcttttccatccggctccagcgcactgacaatattgttattgatgattttgtcaattttcatacaatgtcccatcctataaaataaaaaaccaaccttgaccacgaaaatagaattccattttccataatcaaaattggttttgcctgctttccagtaacaacccacttaatatttatccttacttaaactatatcagtttttttcaaaaaagtcaacaaaattttatacttttttatgtatttttttataaatcctcaacttttcagtctaaaaataaccttccggttcctaaggagcagtaagttgttcacatttttctttgatttcaaaataaatattgaattacaaaaagccttatcaattaatttcccgaaggatcgaaggcatctcttaaagcatcaccaataaaattaatgctgacaaccagtaatatgatcatcagtcccggaggcacccacagccatggcttggatgtgaggatggagatggattgggccccgtttagcatgttgccaaggctggactgaggcggttgaattcccatacccagaaagcttagggctgcttcatccaacatcgatatggcgatcacggaggtcgcatataccagaattggcgcgaccgtattgggaagtatctcagaaaacaggatataacgctttggcattcctgcgacccggtccccctgaataaaattcatctcccgtatggatagaacatttcctctcaccagccgggcaattccgggccaatcaacaaacccgagaatcaatataatatttaaaaggcccggccgaaatatagcggcggaaaccaatacaagcaagatatagggaaaggacatgaccatatcagtaaaacgcatgatgaccatatccaggattcctccgaagaacccggataccaggcccaggaccacaccaatggccgtggacactgcagtagcggcaaaccctaccaacagtgagattctcacggcataaagcattctgcttaatacatcccttcctacctggtcggttccaagcagatgttttattgaaggcggatcgctgaatccgcccaccaccttatccgggtcataaggcgaaagaaccggagcgagcagcgcacataagagaatcatagccaggaatacggcactggccacagccagtttgtgttttaagaaccgcctcattaccgtattgcggtatgtattatcttcactgattattgtgttatctttattcattgattttctcctgcttttaatacgttattgtcggatctaccagtgcgtagatgacatctgtcagcaggtttgccaccagaacaacaatggcggacatcagacagacgcccataatgaccggataatctctgctgataattgcactcatggtcatcatgccaagtccaggccaggaaaatacctgttcaatgatgatggcaccgccaaacaagatcggtatatgcattccgaatatggtaatgaccggaattaatgcattacgaagcgcatgtttattaatcaccagaaagcgtccaattccctttgccctcgccgttcgcagataatccttccggagtatttcaagcatggcgcttcggatataacggatattggttccggccatggaggtcgccaatacaatcacaggcatgatcatatgcctgatgacgtctaaggcacttttctccgctcccagggtatacataccgctggagggcagccagccaagcctgacggtaaaaagatagatcagcaccaatgccagaaaaaatccgggaacactgcttcccaggaaggaaagcgtaactacagtatagtcctgcggcgtatacttgtggaccgcactataaattcctgcaggtaccgcaatcagcatgctgacaaataacgagacagacatcagcagcaaagttggtccgatataggttttaatcatttggcttaccggctgaaaactctttatagaatatcccatattaccctgcaaaagattggtcagccagatccagtattgtacatagacaggctgctgaagacctaaggcaattcttttggtttcaatggctgcctgggacactctgggtccctggagcagttccaatggacttcccaccattgtcatgatcagaaaatcaatgatggttatgccaatcaggaccgggatagcaataagaatacgcttgataatatatttaagcatctgctgcctcctttggccgttcccccagggtcagcaccgggcaggctgctaaatgcccgcttcctggctggatcgggattaaggccgactcggctcgtttgcattcctcaatagcatagggacaccggctatgaaaataacagccggaaggcatattcttattggaaggcagttctccctgcaaaatcactcgtttccttcctctggcatcgggatcgggaatgggtgcggcactgcataatgcctgggtgtaaggatgcaccggattctcaaacagttcctttgcatctgcaagctccacaatttttccaagatacatgacggcaatgcggtcactgatgtatttaaccgcatccagaccgtgtccgataaacagataggtaagcttcagctccctttgcaaatcacgaagcaggttgagaatttgagcctgtattgatacgtccagggcgctgaccggctcatcgcagacgaccagcctggggttaagagacagcgctcttgcgatcccgatcctttgccgttggccgccagagaactcatggggataacgccccttggagtttttcggaagccctaccatgtcaagcaggcggtcaacctccctatggatattctgtcttgtactgacgccatgatacagcattggataggataaggtatcaaaaatacgctttttcggattaagggaggtataagggtcttgaaacaccatctggatctgggtacggattcgtctcattccggctgccgtccggtccgtgaacggatagccttcatagacaatactgccctctgtagggatttccaatgctgccagctgacgcccaatggtggattttccacagccggattcacctaccagtcccagcgtttctccctgatacagttcaaaatccactccgttcacagcatggatcagcccaaccgtatggggaataataccgtcacggaccggataatattttttcaatccctttatctctgccagaggctgtctttccttttgcatgtgctaattccctcctgacgtttgcgtcttcctctcccggatctgagacctccgccagcatcttattccgtgactttcttctatttcaaccagcctttgctccaaatcacagccgtcggcagcataagggcagcggtttgaaaagcggcagccaatgatctccccgtaatgttcaggaacagtgccctcaatcgtcaacagttctctctcttctttatctctgatactgggaatggaattcagcagcgcctgtgtataagggtgccccgggtttttaaataaatcatggacgtctgcttcctctacaatctgcccggcgtacataaccatgacccggtccgccatttcagctacaagtcccatgtcatgggtaattaaaatgattgacatatgaagctctttccgtaagctccttaagagttccataatctgtgcctgaattgtgacatccaatgcagtagtgggctcatctgcaatgagaagcttcggattacaggcaagcgccatggcgatcattaccctttgctgcattccgcctgacagtgtatggggatacttattcataatagaagaaggatccggcagtcctaccttatccaggaggagctctgcccgttccttcgctgttttcctgtccaaatttaaatgtatgcgcatggtttccatgatctgattcccaatggtgaatagcggatttaagctggccatggcgtcctgaaagatcatagtcatctcactaccgcggatccggtcatattccttctccgacaatcccaacaattcctgtccgtcaaagatgacccttcctccggtgattttaccattttctccaagcaagcccatgactgacaaaagcgtgacactcttgcctgagcctgattctccaacgatacacaggatctcgccttgatttacatcaaggctgaccctgtctatgcatttgatatctccggcaacggtggaaaacgccatttccagcgcatctactttcagcagcggaatcattgtgtcacatcccattggtgaatgttattaaaagaaccatacacatcaggcgtcgcattcaccacccttttattcacagccccgattgcgcttatgatataggcagagatcatgggaacctcctgctgcatgacggtatcgatcttaagatattgctctctgatttctttcacatcactggtaacctgagtcgccgccagtgcctgggttacggtatcatttacgtagccggtccaaccgtcggaagataataaccagttaatgtccggatatggatctacgggagcataggtatactgcactgccagcaaatcaaaatccttgcttccagccttagtcattaagctggataagtccacggttgttacctgaatcttgattccgatttcctgcagcttcgcagcaatatagtctgcggcctgacagaacgtggtatctccgctgtttacatagaagttcaatattcttgaagcatcccagccgtccgcaactgcctgggcaaccaactccctggctttttccggattatacgcagtaggggtcaggcttgcatcatagaaaggtcccgcactggacaggaagccgtcaaccacttcaccttttccgtttaaaagccctgttatgatggatgggcggtcaatcccataaagaatcgcctgacgtatacggggatccgttactgtggtagtattaaagaagatcgactgatttgtgacaggagcgccatagtttaccgttacattctcaagggcttccacgctggcataatcctcctgcagaacgccgccggtggtctgctgtacaaagtcaatctctcctgactgcagcccggtcagcaattgtgccgcaggtacgatcttgatatttaaccggttaatcttaggaattcccttccagtatttatcatttgcctcataagacacataatgctgcaaatcaacggaagtgatacggtagggaccgttaactactgtgggagcgttgaaccagtcatagcctgccagatcttcatctgatacgctctccagaacatgcttgggcagcgtcagtatataacgtccataagtattctggaatgtggtaagagccatctgatacttggtcgtaaattggacggttttactgtcaattgccttaacgccggatatttccgtcgccccttcctctgaaaagccatcgtcgcccacgccttcaatggcataaagcgccatgcttgcattggcacggatgggacttgacagcttaagaacggtgtaaaccacatcgtctgcagttacaggctgaccgtcagaccagcttgcgttcggatcaatattcactgtgaaatgaatattgtcctctgtggttatggaagaagccagcattccctcaaactccagattgccgcttaattcaacaagaggcaggaattccattgcagtggaggtcttcatgatctcagtcgcatccatcaacaatgggtttacgctgctgatagaatcagtcattccgatgtttacgatcttatcctctccactctcaccctttgcggaattatcctctgtcttgttttcctttgccggattctcagttccgggaccggaatctggctttgcacaggccgcaagggataccaccatcacaaaaaccagcatggccccaattaccttatgtagtttttgaaagactatttttttcataattgccgtcctcctaaaataaaaaaaattttctcagatacttatcctgcgcactgcatgtattcctcatattggattatacatatatgtttagtatggaatatccttcttaacatattattatgatttcgtttttttgtcaaccatattaatttcaaactgcagcaaccacggctgaacaggacggtatcaggctcctccgactgcggttgtcccccatgaaggtttccgatccagaactggctgtcagttctgaatcggaaaccacgcactttttcgtaacagcaaagaagtccggaacgccctgttgatcgggcctcccagacttttcactcttctcaaccatcaaaaatggatcaataccggtttttctaaaaacaacaaaattttatgcacttatatcttacatgattctatttcttaaatactattctttttaagttcgtctcttaaccgctccaaagcctttttttccagccgggatacataggacctggatattcccataacgtccgcaatctccctctgggtgtattcctttcctccatgaagcccgtacctcattccgataatggttttttcattgtccttcaagcagctgtcaaaggcttcatacagttctttaatatcctgctttaaaataatggtttccagtgtctccttattttccatttcaatgacatctacaaggcttacagtctctccatccttgtctacgccgatcggttcaaacagagaaacttcttttgaatattttttatttgcacgaagaagcattaggatttcatttgctatagtcaccttacggctcctgaggcttaagagtcctttgagccaaataagtacagatggacattctctccatcccatatgaccttatccacaaaggtccggactgccgcccgtttctgccgcacatccataaggtcgattacatttccaaatgaagacagggtctgctttaaaagctgaaactccgggccggaaagctcattgcttccggcagcctgggaaagtgtccatatccgctgctttatttcctctctccttttatccagactgtcaatctgccttatgatgtattcttccgccccagtgcccccggctttcccaagagcagccaccagccctgtgatttctccttcggcattcctaagctcctcctttaaacgggatatgtcccattccagttcctgcctgctctcttccactgcccttttgctgcggcacagctgtttttgaaattcttcatgatcctccgatagctttttgatttcctcaagaaccatctgatccagcatattgccgtttacattcttcattccgcagcatttcatacggcttttttcctttatagtacataaatacgaataaatctgctcccctggtcattgtaccggccagacagctttggacgcatataatcgccgcagcctccgcaaaaaaggatccctgacaacagggctacattgctgcggggcttcctgtaattttttgatttgttttgttccagcagaagctggacgctgacccacatggagcctggaatgatgccctcatgtttcccaaccgccacaatccattctttcatatccttcatttcgtgggtttttccggccttttgaagggtgcggttataggcgatcaccccatggcttccgtcaaaagcttctttttctgcaaacaggtccaccttttttttcagcaaatattcataagcctcctgatccgctgccatatagacgggattggttaatatgccctttatggcaaaacggctgaactgacggccgtattttgtcttatggccgttttgaagcaaatatgtctctgtctgggtcaatgatcctgtttctaaaaatttttcgtaaatcagcctgaccagctttccctcttccggaatcagcttaagcttaaaggccttttttactttgccgtcaatagttacggaagacacgctttccgacgtatagcctgtgggagtattccctcccagccatcttccgcttttggaaagctcaagcatgttatcccgaatgcgctccgcaatggtctctctttccagctgagaaaaaactgaggcaatgtacatcatggcccgccccatgggggaagaggtgtcaaactgctcttttatagaaataaaggaaatatgaagctcgttaagctcttcgatgagatttgcaaaatcgccgatattacggctgatccggtccagacggtagcataccacggccgtaaatttcttctttttcgcctcctgcatcatggctttaaactgaggccgttccaagtttcctccggaaaatccctcatcctcatatacgcaggcgctgtcagcaaggcaatccccataatgcgcggaaatatattgtctgcacagctcaatctgattgccgatgctctctccctttccagtaaattttgactttcttgaataaattgcaaaccgttcttttccggcctccacccaaaccttcctccttattaaacaaaacgctgttccccggagcaatggctgccgccagggcctttcttcataacctttccaggaattcaacagccctcctctattaccgaacatagaggacatgggaaacatcatacattataataagagtatatatcaggtccctggaatgaatatgatcgtacatcaaccgaaaaccaaagaagacaggaaagaattagaaagaaaagccgccattctccatagccaggctgtccttcagtatgtacagcagcttgcctgccccaatgatcaaaaacaggctcttatagaagagcttcacacaatctgaattgtattcatatgcttcccgccggaaaagacatgtgtggcacaggatacacacgggtcaaaggaacgtatgatcctgccgatctccacaggtgtttccacattgtttacaggcgttccgatgagagcctgttctccggttcccttcatcccgtttgactgggttgacagattccatgcggacggcgttatgatctggtagaaagcgatttccctgttttcaatatacagccagtggccaagggcccctcttgtcgtgtcaaccagccctttcccgacgactgcacaggaatctcatattcctcctgcatgaatacacccggaatcaaattgtctatcagtgtttgcattatttccacaattttcttggcctccaaagctcttgcgatggtccggtccatggcagatatcccgtttccatactcaccggaaagccactgccttgcaagcggtcctacctcatagggtacattgtcatatctcggtgcctttatccaggaatacgcctgggacttgctcctatcaggttcatcttcttcattgaaccatgcatactcatcttcctgggttataaggtcaggatcaaaaggggatgtacggccttttgaaaaaacaagaggatccacatacaacgttcccaaatctctgtaatcataaaagcttccataagttaataagttcccatagcccccgcccatatgatagtactccggataatacgttccaatggtgtagacatcgggaatcattttttccatgataaattgtcctatgccatatagtatagattttatgctgatgatcatatctgccgagactggtgatgtgatccctccgataaataccccatggttgtggggggctttccctcccagtatggcaagcatctgatgggcgctgcggctgaactcaagggattcaaaataatcgtttaccattttttcatttatgtcctttggaaatctgtaatcattatgatctcttttaaacaacggataatcatccggaagctttacatagtccgggagggtaaactgataaaaatgccttaagtgattttgcagaaactcacatgcatgaagcaagtccctgaggtaccttccctgctgggaggggacaatgttcaatgcttcttccagcgcaagggcagaggccatggaatgggcggtggagcagatcccgcagatccgctgcgtgaaatatacagcgtcaaaaggacttctgccctgaagcatcttttcaaatccccggaacatcataccctttgttttcgcatccacaatggattctttttcaatgtcggcttcaatctccatgaaaccattgatacgggtaataggatttatggttattttctcggccatgtctactcctctctcatggtgtcgtaaatgataaacggctccattgcatcgggaaatccaaactgggcacagccaatacaaggagaatcatctcctaccggccagttaacatgcccgttccactgacgtatgggacagtcaatctccgtaaccggccccttgcagcccagcatgaacaagcaggtttcttccccaagcttttcagcaaagataccattgtcataataggaccttcttgggcatctgtcgtgaatagtcgtactgtaaaacatcaggggacggtccctgttatcaagaggaggctccccgtataatatgagataagccagagtgcccatgaaccagtccggatggcagggacatcctgtcagtttaatcactttacggcccagaacatcctgtattcccacacattgcgtaggatttggccttgccgcagacacacctccgtgtgaagcgcaggcccccacggcaatcacatgagctgcacgttctcccagcctttttactgcttccaatcccgttatttccctgccgtttctccggccaatggtctgataggaaccgttatcctttaaagataccgctccctccgcagccaggatataattgctgcctatgatgccgaacagctgttccatggcctcatctccttcggaagcgatgagactgttgctgtatatgaaattgctcatttgagtcagcagatactggaaatccggattctgaccgtcaagaagggaaatggtattgccggtgcatccgtttaattcaagccagaccagattctgctttggacgtacacggtttctgatgtcgcttctcaccctgttcacaaggctttccgttgtttttaatctgctttcctgataaggacatttaaagcttgcggaatccaaattcatcaccagctttacacgggagtcagatagcctacgatcggcagtctggttaagaccattgcaccgggatggcaggtctgaaattcactcgttaaatcatttccaggattaaggccaaaatggctgtctcccctccagacggcattatttgtaacatcatataccactccgtttactgcaacataggcaggagcaccgttcttgccgtcatattctgataattcatccagagtgaagtatctcggaacggcgccttcctcctggttttggcttgcatggatgatgtcataaggattttctatttcttccatgcttaaatggtttgactggctgaaatatttgatatggctttccagcataatcacttcaccgcttaaatgatccaatacggtgctgctgttgtactgatcggaataaagcctttccacatcttcattaatttgccttacacagttcccgatgtaatctaaaaacaaatttaattccataaaaaacctccaaaaataaaaaacatacaattgttactatagtttaccggccagtatgcggcctgctttattggaatttctctccatcgatcctgtctatgatggcagtgagaggttctatttcctgtttgcggaccataatgtttgtccagtcaccgataagcgcattttttctttcagaaaaatattcccggatgctgtccttgctgatatggctgttcgtatgtaccgtaattgtcagatccagaatcttcgcaatggcgttttctttgcataagtcaatgattgactcatataaattttgatttaagaaagtgtcatgcataaatggcttcctcccatatgattttttgaatagcaccttcaatctcctgacagatctgaggcagcttatcccttaaaacagggctgagttcatggccaagaccgatttcggagatttcaatgccaatgagataccccttaaacggaacgccgtacagcttcatgagttccaacatgcttaaatcatgctgcatagagagcaaggaaggctctgacatcacgtcttccaagcgaaataaatggactcttccaggctctgcccttggggaaagtgcgtcaagtataaaaataaagtcatcttcattcagtaaataaaaacagttttggaaatcggtttcaccaatgattacatggatatcctggtgaatcagccggtcttccagcatttcggcagcttcaattgctatagcgtcatccttcataaaccggttgccgatagcaactaacttcaccatatccttgcctccttttttatttttgttatttatcaatatatatgttggacataatcaaatattctttgccgggggaatattgcaggaaaggttgtatcaacccagaattgggaggaaaaaaaaggatgattttctcaaaacttttatgcataattcacataaactttcctaaacttttgcgctatttgcacatatttttgcaattttttagaaaaatcccgcttgcacccttattgatttgaggatatactgaatgctggatcagccattgatttgagctgttcaaaataatgatttgggagcttatgatgaaggtttcttttataaaaattttctttccgaaaaaatctcagagtgaaaattaccgtattctttcttgtcatggtaatatccattgccgctgcactggcatatattctatacctgcaaagctataacatgatcaccagcagagctgccgaagaggcgttccggacagtatcccagtccggtaagtaccttgatttggaaaagtttaaaaccttgatatccatagaagatgaaaacacggcctattatattcaggaaagagacaacctgataaaaataagagaaatcagactcctcctatgagcaggcctggagcggcatcccatatgcagacagtaagttaaacgttgtagaaggatggggcatatttataagctcctattaccctctaaaggacagacagggcaatgttgtgggaattataggtgcagattttgatgctgaatcaatttatcaggaacttaaccgttttaaggaaatcagcctcctggttcttatggccttcacagtagttattgttttatcaggattgatttttccgaaaaaatatcacattctgttaagtgcgcctccgattactcgaaaagactggctgaatttgacttaaaaagtgatcattcaaaaaatcaatgtttcttccagacaggtggccatcacttctcagcagcttacggccgcttcctctcagtcttccagaactgcggaagaggtatcaaagaccattcaggaaattgcaggcagggccttggagcaatcagaacacaccatggagggaaccgctaagatcggcctcccaaaaggcttccctgcaattaagcaatacgggaaaagatatgtatgatatgaaaaacataatactggctttactggagcatttagccggaatcgcaaagcagaattcatctgccgcaggagaagtaaaccggtccatggaggaagaagccggtgcattggaaaagattgcagcctcaagtgacatgttatctggactggctgaggatttgcatgatatgatcctggaatttaaaatataatatgagaaaacggtttagagccgttatgataggataccattctccacacatttggccgcataagtggccagtctggagcctcggtccggatgaaaggtattaacggctttaataagtcctatggttcctacggaaagaagatcttccatatcataatccgtattttgatatttctttgccacatgtgccaccaggcgcatattccgctcgatgagtgtggctctcgcctcccgatccccttcctggtatcgttccagacactctcgttcttctcgcgcagttaaaggtttgggaaaagtcttcaaagaaagccaccttaaacttacttactctcattttatgccgcccttctctttaaagtgcttttacaaaaaatataggctggtacttattttccttttccatcctgaaacgggccgcacccaaaaacaaagaatatgtggacaataaaaacggaatcagcctgttataaaaaggcctgattccgttttaagggtcaatgatggaacaggcgcactcctgtaaatgccatggccattccatatttattacaggtttcaattacctggtcatcccggaccgagcctcccggctgtgccacgtaccgcacaccgcttttataagcacggtcaatgttgtcgccaaaggggaagaatgcgtcggatcccagagaaacgtctgtcagctgattcagccatgcccgtttctcttcccctgtaaatacaggcggttttaccctgaaaatattctcccatctgccgtctgcaattacatccataaaatcatcgccaatgtaaacatcaatggcattgtccctgtccgcacggccgatgccatccacaaaggaaaggtccagcacctggggagcctggcgtaaaaaccagttgtcagccttgcttcccgccagcctggtgcagtgaatgcgggactgctggcctgctccgatgccgatggcctgtccgccctttgcaaagcagacagaattggactgggtgtattttaatgtgataagggaaatgattaagtcaatttttgatgattgagggatttcctggttttctgtcaccagattccttaaaagcccttcatcaatttttacatcattccttccctgctcaaaggtgatgccgtaaacctgcttcctttcaagaggctccggtacataatccggttccatgctgataacgttataattgccgtttttcttggactttaagatttccagggcctccggctcatatccgggagcaatgacgccgtcagatacttcccgcttgatgatcctggctgtatccacatcacagatatctgacagggaaatgaaatccccgaaggaagacatgcggtcagctcctcttgcccttgcataggcacaggccaggggtgaaagcccttccatatcctccacccggtaaatccttgcaagggtccggtcaagaggcagtcccactgctgcgccggccggtgacacatgcttaaaagaagaagccgcaggaaggccggtggcttcctttaattcctttaccagctgccagccatggaaggcatccaggaaattgatatatcccggccggccgcttaagacctgaatgggaagctctttcccatcattcataaaaattctggagggtttctgatttgggttgcagccgtattttaattccagttcattcatcttttgtactcctgtcattggtttttattcacgatccgggtctcatagtctcccgattcaatgtcaatatatcttacaaaaagagagatcttattttcctcataaaggctttcccacaccatggcggtaaactcatccagatcatccagggtttctaccagctttggctccccttcaaagcttggcagcggattgccatcatgcatataggtatgaatgaagtgagcctctcctgccgccggattgtcataggcaaaggtatagcggttgcaggaatccgggttcccgtgattgctttttatgatggacatggcgtaattaaagcggtctccctccatatgcattatgccggaaatgcggggcgtataattaggactgtccggctcaaattccctgcaccgcagggactgctcaaaggtcagctgtatatccattcccttataaatggtatctgtatggtccccgtttgtgacaatggttttattgcccataacccgcaccggagcataaataataaggcttgggtcagtgacctttgaagggtcaaaggcctgggtacgtattcctgttccttcctccacgaatacgcggttgcggctgttttcgcttctccccataatgaaataggcggcaactgctttcctgccatccggcgtctttcccatgacaatgcctcttccaggataggaattgttctttaaatcctcttgtaaagaaatcaaactcatcaaatctggtctcctttctgaataaaaacacaaaaaaccgcctgggcatcccttagggcgcccaggcggtcggcttttttgtatcgtgctccccgtggtttcactccactgatccgccagtcgcacgtaccttgtctaacatcatataatattcccaaaagaaatgcaagccccttttataaatcagttattcattccttatggctgcaagagggcttaacttcattgcccttagggcagggaaaaatcctgcggccatgcctacaaatacagcaaaacccacggctgccagagaaagccatggagggatcctggaaagatcgcctggcatgcctggcataaaacggcctgaaaggaacttattaatgaggaatgaaaccccgtagctgaataagatccctgtgattcctcctaaaaagccgataaagccggattccagaagaaacatgtttctgatattattcatatcacagcccagaacctttaaaatcccgatttcctttgttctttcataaatggacatcatcatggtattggcaatgccgatggcagccacaaataaggatactgctccgatccctcccaaaagggcctgaaccattttggcctgtttctgggactgttccagccattccatattgctgttggcctgataacccatatctgtaatggccttctgcactgccgtaacattgttcatatcatctacttccacaattgcctgctggtaaataaaatagttgtaaggtttcccctttttattggtaggctgattgggaatgggcttctttttaaaaatctgtttcaactgggattttaaagcttccaaatccacataaacgctgtagctgtagctgttccattcctcctgccctcctgccaccagtccggctgttggtatcaggtactttttaggcggcttgacggttgtgcctccatctcccgttccccctccctgagactgataataagcatccatatcaaaaatcacaaacagaggcttatttataaaatctatgtcaggaatgctggaagaatcatcataatagccgtaacgattgcttttgggattgttgaaattcctggcgaccatattccccacaaccatttgaaggtccctctttcccggttccgggagacttccttcctttaacggaatgtttttcatgtactccggggaaactccgatcaggttgatatatgcctgataaactccctgggtcattaaaacgttagtctccaaaagggggaggctgtgttaacatgctcgatctgtccaaactgtgagattacatcgtccgtcatgtaattaggatccttgctgctgtcatttcctccccacatggcgttggaatatacagaaatttccgtaaggcttccgtaggaagcgatctgttccatggtaagttcattaaagccgattcccaaagacaccatgacaacaatggaagccgtaccgatcaaaactcccagaaccgttaaaaatgtccttaatttcctgcgtcttaagttatttacactcatggatagcaaatcgctaaatctcattgtctttttcctcttctggttctaatgcttctaatgcttctgcttcctttttctttttgcgccttttaagcacaactacagttccaatggttcctataaccaaaacggcaatgaccgccggaatgacgaactttccatatttagaggatccttccggctctgttacagccggaaattctcctgaaccatccattccgggatccaggctttcctgctctgttaccgttaaagtgatttctttttcaatgggatcgctgactacaccgttttcgtcctcataggtgatcatgaccttgactttcccatcatccatggtgggagctattccgctgatcatggcatctacattccctgattctcccggttttatatttcccacatagctgttggtctgctggatagagtctcctacaaaagccaccattacgttgtaaaggagtacctttcccgtattattgataggaaacatcacattggtctccgaacctacggaaatcatatcaggcatcacctcaatggttcccgtattcagcctggaaacctgtttgacagggatgttcaccgtcaccttttcttccgcattcttaaactcagggctgtcatatttttcattaatggtgatggcataggtcctttgatccacccaggctcctgcccgaagcttcagctttatatctgtggtctggcccgcggccagtgaatttacaacaatggaagaggctccggaatccatagtaaataccgcgctgtccgtcaccttttctgattccaggttaaagaggatgttgcttgcggcaacgttttcggaggcgtttttcatatgaaggatcatttcaaactcctccccggcgtaaactgtttccgggttggtctggaatccatctacaatgattctggcctttgtcctgtcattagcgttgaaatcaccggtttcttcttccttgtctttattctggatatttacatagaaggtctcttccgccttctgtatgtctccatccgtgctgtcacggtattcgatggtaaaggttatggggtaatatccgctgtaaacatccttgcggatgttcatgctgtatgggacctccaccgtctctcctccgccgatccgttcgtaatgtctggtgtagtttccgtcattaatatcaaagggaaacttggtgctgtcctggctcagacccatccggatatctacatcaaaggctgtaacattggaagagttgcggacattcatattaaaattcaaagtctggggatatgtaccaaaaggcgtattctggttttctcccagttcaaactggatggttccttcatcttttccggattccgtggttgaggaggattttgtgatccagatgtttaccttttcataactggcatgagctccgtcatcctttttaaatgcatcggttactacttccaaaggtattaggtaatagccttctgctatgtctctccggacccttgcggtgagagaaatagtcttagaagttccgctctttaccgttcccagctttttgttatcaaaggtactggaagtgatctcaaaaggaaagattgctcccgaatactttgtctcttcatcagcattttccgttgcctgatattcctgttccgccagatcactgtcaaatctcactgctacgttgttcaaatcattgctgccattattggtgaaaaccatattaatggtaacgttttctcctgttttcccggatggggttttctttacgtcaatgtaggtatttctgcttaagtcatattgggcaaaagccgcgccaggcacagccgaaataagcataatggccgcaagcagccacagaaatcctctcctacccttgttcatttaccatatcctccttcgtatcctcatgatgctgttcttcgattttaataatttttccatcaactatatggaactgtctgtctgcaaactttgcaatataattatcatgagttaccatgaccagagtctgattctgctccctcacgattttctgcatcaggcttaaaatttccctggtcgtcttggaatccaggtttccggttggctcatctgcaaagatgatctggggatctaccgccaatgctcttgcaatgccgaccctctgctgctggccgcctgacatttcattggccatatgcttcatctgcttctctagccctaccagctttatgtactctctcgccttctcattcctcactttctttgacactccccgaaatgacaaaggcatggccacgttctctaccgcattcattgtctgtaataggttataagactgaaaaataaaacccacatgctttctgcgaaacgataccagctgattttctgaaagcttttcaatatggcttttgccaatgacaatctctccctttgtgggcttttcaagacctgccaacatatttaaaagagtggatttaccggatccggatgggcctacgattgcacaaaattcccctttgtatatggtgaagtctacgccgtttaatgcatagacctttgtgtttcccactttgtacaccttatagagattcttgacctgaatcataggtgttttgtctttttccaaagcagattcctccttaatataagtctgcagtgtggacgttaatgcatggtgcagctgttagcacacacagtgtagcatgtcaatacacggtgtagcacgttaacacacggtgcagtccgccaatccgcagtgcagccagggaacccacgggttccctggctcacgggctttcgccctatgaatgagagcaaagacaaattttcttatgtgcaggcacaacgaaaatttgtctttgctctcattcgcactgctcattgcttcatgaacattatacaacaacatatttacatcggtcattctttattttcttacacttccttaaatattccttacatatggtttttcaatttatggagggagccttaggtttggattatattataatttttaaaaaagtgttgaaatattttatttaatactgtatagtagatgggatagaattttaaaccataatttagtggataaaggagattcttatgagacatttacttaacccgttagactttagtgtggaagaaaccggacaacttttagatctggcaaaagatatcgaagaaaatcttccaaaatattctcatgtatgcgatggaaaaaaattagcgacattattttatgagccaagtacaagaactcgtttgagttttgaggctgccatgttaagtttgggcggcagtgtactaggcttttcttctgctgactccagttctgccgcaaaaggagaaagtgtcgctgacaccattagggtcctttcctgctacgcagacatatgtgccatgagacatccaaaagaaggggctccgctggtcgctgccaatcattccaccataccggtaatcaatgcgggagacggaggccaccagcacccgacccagacattgactgatctgctttccatacgttctttaaaaggccgcttaaatgatctgaccatcggcctttgcggtgatttaaaatttggccgtactgtccactctctcattaacgctctcgtacgatatgaaaacatcaaatttatcttaatttctcccccagaactgagagtgcctgaatacatccgggaagatgtactgaaggccaacaacattgaatttttggaaatggacagccttgatgaagccatgccgtctcttgatatcctttatatgaccagggttcagaaggaacgcttcttcaacgaagaagactatatccgcttaaaagactgctacattctggacaaaaagaaaatgaagcttgcaaaagaagatatgtatgttcttcatccccttccaagagtcaacgaaatttcagtggagattgacgaagatcccagagctgcctactttaagcaggcacaatacggcgtgtacgtgcgcatggcccttatcatgacattactggaggtagaaaaatcatgttaaatatcagcggattaaaagaaggaatcgtattagaccacatagaagccggaaaaagccttgaaatttattataacctgggtctggacaagctggactgccaggtagctatcatcaagaatgccagaagtaataagatgggaaaaaaagacatcataaaaatagaaggcggcttagatcatattgacctggacatcttaggttatattgaccataacattacagtcaacatcattcgggataatctgatcgtggaaaagaaagccttaagccttcccaaaaagatcaccaacgtgattcactgcaagaatccccgctgcatcacctccatcgagcagggacttccccatgtattctatctcgccgatgaagacaaagaagtttaccgctgcagatactgcgaggaaaaatactcgaaatagaaaaaaggcccggctcagccgggcttttcttgttttaaagttttgagcaagacgataagccgggttatgtcgttgaatggccatctatctaggcctgccgtcgccgacaggctcaagcgacctacccgggagcagacgggccgtcttatgccccctgttcggtcttgcttcggatggggtttacatggacccctcctgttaccagaagggcggtggtctcttacaccacctttccacccttaccgcatataaaatatgcggcggtatatttctgttgcactttccctagagtcgcctccgccagacgttatctggcatcctgccctgtgaagcccggactttcctcatctgcagcctttcggctttgcagctgcggccatttgtcttactcaaacctatattatgaaaacgaaaacctgttttcatgttccaatggatggtgctaaaaagccgcaccttttatgagaagcaaaaaaaacagtttctcataagccatattaacatatcacacatttatttatttgtaaagcagcttttggccctaaactttaaaacagcttcctccgatgaactctctgacaatggaattacggggaatatcctcgctgttgaccccaagaaaataatcgaggaattttaacagacgctttgcttccatatattcgggggattctcttggaataccaaacaacagcggttccgcatactgctttaacacagacagctcataaaccgtggcggaattgaacatcatatcagcagactcctggaaggggaaaatatattcttcctctccttcccttaccgagggccacattcgtatggtgtcatgtgcagaagcgcctcttgttctggcatcccgcaccatccgccggatcagtcggcaatcagttgtgggaatccggttgtgctcatctacgttcagctgagtcagagcgcttacatatacacggaatttactttcctttggaagagaataagacagcctgtcatttaaacaatgaatcccctcaatgaccaggatatcatcttttccaagctttaaataatcacctctgtactcccggactcccgtcttaaactgataccgcggcatctccacagtctctccggccaagagggccgtcatgtctttattaaactgttcaatgtcaagacattccaaaacctcataattatagctgccatccggatttctgggactgtctacccggtttacaaagtaatcatctacggcaatggggtgcgggatcattccctgagcctttaactgaacggacaggcggtgggaaaaggtggttttcccggatgaagaaggcccggcgatcatgacaaatttcttgctcctgtcagctcctatctttcccgcgatctccgcaattttcttttcctgaagcgcctcctgtatcaaaatcagctcattgatattgccggctgcaatttcttcattaagagctccaacatgggaaacgttcagccgttcccccattttacgctttcctttaacacctggaacagctttcgctttgcctctgcctcaaatacaggcacctcttccggattttccttttggggcagcatgagcataaagccgtcatcgtataatatcagatcaaaatacttaatatatccggtattttgtaccatatatccataataataatcttcaaaaccgcctatgctgtaaatgttaacgcgggaaacccggcgatagcggaataatctttccttgtcatacatccggtgtttgtgaaacagctcaatggcatcatcggtgtttacattccgtttcataatcgggattttctggctcacataatccttcatgcgggcctttaccctggaaagcagatcttctgtcagcttgacatctccatggggttcaatgtaatagccttttccaagagaaaaatccacagtgaccttttcaatattttccgctccggccacgtcataaaaggccttcatcataagaaaaatagcacttctgtgataggtctggattcctggctggtctttccctgtaaaaaaacgaaggttgcagtcaaactggactgttttatggagttcactcagctttccgtttatactgaccagtaaaatgtcgttttcgtactggtgctgatattcctttgcaatttcttgataagacgtaccaattggatattcctttgctgcgccgtctatagtaacaattgccattcccttcctccttatatgaatgtttcaggaaattccacttctgccttgcggatttccaggtttttccctgcctttttctttaagtaatcttctataaagtccagaaacaaatattccaggccgtaatggccggcatcaatgacagccatgtgatttgcagcggcatcgattccattgtggtggcccatatcacctgttataaagactttcacacctgctttcagagccggtttcataaggcttccccctgatccggggcttatgcccacaaagcgtacagcagcccctggagcagcctctccgtaaaccgtgacaaacggaaggcaaaaccgttcctttacaagagcggcgatttcccttaccgtcatctcttccttaagataccccgttttcccgattccatataccgattcctccagtccttcctctgtttccctgggtatcacgccttctttttccagcacctctaagtctgtaagcccaagttttgctgcggccgcatcagccatacagcccggtgccgcatcaaaattcgtgtgcatggcataataggaaatatcattgcggatcagcttcataatacggcgggatataaaatccttgtcattgatcttactcaaaggtttaaaaataaggggatggtgtgtgatcaataaatccgccccccaacgaacagcctgttccaccacctcatcggtagcatccaaagctataaaaaccttttccacctctttatcactgcggcctgccaaaaggcccacattatcccaatcacaggcacagcctggcggcgccagctgttccagtttttctattaattcatcgcatcgcatcctgtgcctccttattataggccagttccagcttaagctcctccattcttctccgggctgactcggtttcactcacagaaagcccgctcatgatctgctccagctgttcttcttcctttattaaatattcctttaaaacaggatcttttgattccagcatgcccctgccataacggtaggaaatttcccttccatccgctgcggcagcccccggttttctgctgacccccataacggaataatattttccttcctcttttatcatagtctccctccagataaaaaatgcctcttcctcaaggaatctacgcaccttatccagttctgagtgcggagacaggacccagcaggaaatgctctcccataaatctcggccttcctccaggatatgtatcatcagctccccgcccatacctgctatgaccacacagtctgcttcgttttgttctaattttaaaagtccgtcgcttaaacggacttccacataattctgtaagccggcctcctggatatgggcccgggcccgtaacaaggggccctccctcacatccatggcaatggcatgttttgcttttccttcctgtaccagatggataggaatataaccatgatcggttccaatatcagcaactctgcttccttccggaacaaaggaagcgatggtttccaaacgccttgataacttcatcttaaactccgtcttatgtccttaatcatccagatagtccttaagcttcttgcttctgctgggatggcgcagtttacgcaatgcttttgcttctatctggcgaatccgttctctcgtaacattaaattcttttcccacttcttccagggtccttggccgcccgtcatcaagaccgaaacgcagttttaaaaccttctgttccctctctgtcagggtgtcaagcacctccatcagctgttcatggagcatggtaaaggtagcggcatcagcaggaactgctacctggtcatcctggataaaatcacccaggtgactgtcctcttcctctccgatgggagtctctagggagaccggttcctgggataccttcatgatttccctgacccgttccacctgcatgtctgccctggctgcgatctcctccggcaccggctcccgtcccagctcctgcaaaagctgtctggatacacggaccaggcggttgattgtctccaccatgtgaaccggaatgcggatagtacgggcctggtccgcaatagcacgggtgattgcctgtctgatccaccaggttgcataggtactgaacttatatcctttcctgtagtcaaacttttcaacagctttaataagacctaagtttccttcctggatcaggtctaaaaactgcattccccgcccgacatagcgcttggcaatgctgactaccagacgtaagttggcttccgtcagcctctgctttgcatcctcgtcgcccagctcgatcttcttggcgagctcaatttcatcctcactggaaagaaggggaaccttgccgatctcttttaagtacatgcggaccgggtcctccacactgataccttccggaacagacagatcgatcgtttccatatcgatctcttcttcctcctcgatatcctcctcaatgaaaagatcttcatcaagctccaaatcttcaccgccgatttgaagtacgtccaccttattgctttccagaaaatcaaagatctgatccagcttatccgagtccagattctctcctacaaaaaaatccagaatttcctggttttccagtacattccgtttcttttttgccaaaagaagaagctggtttaatttttcctcaaatgcagcggctgcttccaaagccttagcctctgcggcctgctcctcttctgtttttctcgatcccaccatcttatctgctgtcttcttcacattttcgtccatgttcttccatccttccacagcctgcctatagtgtacaccctaatccagcgaaatatgcaaatcctttaacgcagcctgttcctttataatattctgcagttctataatccctgctgcatggcggctggcatgatccagactgttttttttcaccttcataatcgtttccgaaaacgcctttttttgttcttcattatctagggactcttttaagctcgcatgaaaaagacctgcgactgcccggtattgatcctcatcatttatgaaatgattcaagatctcggccggattcaatgttccggcagcgtgtccgtcaaaaaccatccgtgccaccttgtgatacagttcttctataaaatcatccggagtgatcactccttcaatcttatcaaataataatggattttcaatgagccacgtaagaagcagcctttgggactgctttacgccatcttccttttccttttttcgctgggtttttaggtttccctcttcctccctgggagcggaaacagacggtcccagagaagcgcccaaacggttgaccagacgttttaaatcctcgtaatttataaaatactccctggatactgcctctaaataattctcccgttccagggcctccggaaattccagaagctttctggctacctgattgtagaatgctgttttctgctccggatcatccattttataattttttttcaacacgtcaatttcatacaggaaactgttgcgggcctcttcgatccgctggcggaacgcttctgctcccagattctttataaattcatcgggatctttgtaaggctgcatgttgagcacgcgaatggacattcctgcttcctttagaatggggatggcacggatggcagccttaataccagcaccgtcgctgtcataagtgagaaccaccttatccgtataccgttttaagagctgggcatgctggagggtaaacgccgttcccagggaagccaccgcattggtgaatccggcctggtgcattgcgatcacatccatgtagccctcgcagatcaatatgtacttttcccgtgataacctggcataattaagtccgtatagattccggctcttatcaaagagctttgtctccggagaatttaagtacttgggttctccggctcccatgacccggcctccgaaaccaatgacccggttgttcacatccataatgggaaacatcacccggttccagaacttatcataggttccccgttcctcaatggtcaccagtccggtctgctttaggaggctgtcgccatatcccttgctctttaaataacggtaaaggtcatcgctggtcttattggaatagcccagcccgaacttggttatggtttcatcgcttaactgcctgtcccttaaatagcggtaaccggcctccccctgagtttttttaagctggtaataaaaataactggcggccagcttattgatctccaaaagggcggaccgaagatcctcctgttccctggcctccttgctatattctgccgcaggaagcttcacgcctgaccggtctgccagaacttttaatgcctcggaaaaggaataattttcatattccatgacaaacgttaatacgtttcctcctgcaccgcagccaaaacaataatacatctgcttggcaggggatacggaaaaggaaggagacttttcattgtgaaaaggacacaggccaaaataattgcttccctttttctgcagcttgacgtatcccgagatcacatccacgatgtcattcttcatccggacctcttcaatcacttcttccgaatatcgcatgaagcctcatttctcctttctccttttctggccatgtcttttgaccaggggccaccccgctttatcgggtgtaaagatataccccagggtgttcctaaaactcatttgatttaaaccgttttccacgctttcgggacaaacagctcttcaaatctatcaatggaatagctgtcgctcatgcctgcaatgtaatcgcagaccgcccgttccctgccggcctgcccctcctccattaaggtgcggtattcctccggaagcttgtccgggtgttccatataataattaaaaagcatgacaatgagatgctgtgcttttccttcttctgctttcgggatatcgcttttatagacgttatcaaacatccaggtgcgcagtccctgcatggctttctccatatccggggacatgatgatctcaggcctcccatagctgttgccgatgatatcatggatcaggttgttaagcctttcacggacactgtgccccagaatacccgtatagcattccggaaggtcctcttccacaaacatcctggccctgatggcgtcgtcaatgtcatggttgatataggcaattttatccgacagccggacaatgcctccctccaatgtggacgggcggccgctggtgcgatgatttaatatcccatcccggacctcccatgtgagatttaagcccatgccgttcttttccaaaacctccaccacccggacgctctgcttatagtgggcaaaaccttcggagcagattttgtttaaaatcgcttccccggaatggccgaaaggagtatggcccaggtcatgagccagtgctatggcctccgttaagtcctcgttcatccgcagggacttggctatggtcctggcaatctgggatacctccagggtatgggtcagcctggttctgtaatggtccccctcgggagccagaaaaacctgagttttgtgttttaacctgcgaaatgccttacagtgaatgatccggtcccggtcccgttgataagcagtccggatatcacaagcctgctcttcccgctctcttcctctgctgtttttactgaaagcggcataaggacttaaatatgcttcctcccattgttccgtggattccctgatattcatacaatcacatccttcgcccaaagttatggtacattatatcatattttcagtaattataataccctatattaaaataattgtaacaggtcatacatgccattcctgatccgggtgataaatcatacttccgaagggaggatggcataagacgcaaaattattcatgaggcatatccagacatttcctgtattcactgggaaggcagccataccgctttttaaaggctttggaaaaagccctgctgtccggaaatccatgtttcatggcaatctctccgatttcaccgccgcttcccaccagttccctcaccgcatatttgacacgcaggtcaatgagataggtgcggtaattgacctgcgcatatttttgaaagatccgggacaaataagtggggctgaaaccaaaacgccctgccacctggtcaagttttaagtcctggtcataattttcccgcatatactgggtgacctttgaaagcttatcgagctgctttttctggcggagaacctccttatccatggtttctgttttaaattctgtgaccagaagatatagaagctcatagaactggctcttcaccttcagactgtaaccatattcctgcttttcataaacggaaaacatggaaaccaccatctgcatcagtctttgattctgagcttctgactttttctcaaaattcacatagttttcttctcccatgtacccctcaaaagtctctgccggtatctggaggactatggtgatatttggattggggcactcaatggaatggacttcattggaattgacaagcacaaaatcctgccgctcaagggataaatgactgttgttgatataaaaatcaatctttccctcctgaaccagaaaaatctcaacggaatggtgccagtgctttgtgaccttataatttccatccctgccttcaaaaataaacattcgaaaaggcagatcatcattgggaatgaccagttcatgtctgacttccacttcacacctccccaaacttagtgattccattataaaacattttgatcatttttccaatggcttttcctcttcccgtccatgctctttggacataaaggtatgccatcagggcgttcctcccatgtcatacgggaaggctgtcgctcacacataatgctccgtatccaacctcaggattagggtatgatgtgattcccggaaggggcctggccccgcggattaaataagcttttatcttttccccgaacaggaacggatctctcccatccacaattccccactgcatcaaaagggcggaactgccggtgacaaagggggttgcaaaggaagtgcctgtcactgattcataaccgcctccggtccttgcagcgatgattcccacaccgggagcagccagatccggttttaccaggttggtcctccttgtaaatcctctgccggaaaagtccgcataggactgataggtatcgtcatatgctcccacggaaataactttggtagccgtagacggaatggtcaaggtggtttcaggtgttgctcttaaaaaccgggtggactggttcagcactcccgcagatggaagccagagatcgtatttcccttccacgatctgcctgggagtcaggcggaacccccagatcccgctttctatataggtatcaatgggaaggaaatccagatagatttcctgggccacactgtaaggacctggttttccatagtacagcaagattctggtatttctgtagtttatagtctgaggtcccagtctgctgctgatgggtccgatcacttctccggaaggggttataatgctgatatcaaacaaatccgcataagatttccatagctgcacgctgaagctctgctggtaccctcccacgctcagttcgatatcctgaggatttgacattgtcaggactcctgaaatatggccgccgctcaccccttcgttgcctgttcccaccacgatagcagtttttccgtagttggatatatcatcgagaaaggtttctaaaagactggttccgtcatgagaaccgtatgtatttccaaagcttaagttaatgaccagaggtatctgcatatccacggcttccctcaccgcaaaattaactgcccgcataagctccgtggttctgggaaagccgctttcctggggaactccaagcttaaccactaacagaggactttcgaaagcaactccccggtactgccccctgttttctcttccgtttcctgctgctatggatgccacggctgtgccatgacctgtgatatccacggagggaaccagcctccttgcctctgccctgcttccggtagccagagccgcgttgatttcttctgccgtaaacacctggtccagggtctgatcccaaagccttacgatcctggtggtcccgtcattattccggaaatcatcgtgataataatcaatacccgaatcaatgacagctaccaaaacgtctcttcctgtcagaatactgcttccttgctggaccagattgacacaagaggccgcctttgcctgattgattgcaaaaaacagcctctttggtttctctacatattcgatttgcggcaattcacttaacctgtcaataagggattccggaaccgtaagaatggcgtattcattcaccatgggttccacccggattcctgcctgggcaagaccgcttatgtctccggaatactttacaatcacatcccatgattgttccccaggattgtatcctacgtttaaattgcctgatttttcccgctcttcgggagttgcgctgagggcgaggtttaacaggttttccagtttctgatcctgcatatgacattccttcgttttttctatcatcctacgctggaaatgtcattctcattcctttctctgctccgcttcccgtacttctgtatcgtggtagtagaatttcagaatatcttcaaaattctttccttcctttgccatggcctgagcaccattctgactcatgccgactccgtggccaaagcctcctccataaatatggaaagtggtaatattattgtcatcaacaccctggttttctattgcaatgtaggcgcttgggagagagtcaaagttcttcataagcgtgccatccagtttggtgattatcatatatttgtttccaagctttgccctcacctgtccttctccattaatggtcataacgccgtcagatccttcgaccctcagtttttttacaattccgcccactccccgttccgttaccgtaatgtttaggatagagcccacctcggtgatctcttcctccagctgcctgttggtgacagtggtttcccaccggtacatagggaacgacgagtcataggccggatagtcttttttctttataaattcttcaaaatcagagtttgtggacaggtttaaaacacctctgctgtcctgaagaaggctgccatctaaataggggaactgggccgggtcgcctccccatacgcttccgtcagtggtgtgtccgcaggaggttgaaaaataaaaggcctcaatcggactgttatcgtaaaacaacagctttccataggtctcccgcaccgcctcctctgttttcgacgcggcaggaagattgttgtaaacctggaatctggtgctgtcatccacatgggcaccgtatttgctgtaggtgttgctctggatctggcggaaggcgtaagtcctggcgcagacagcctgggcctttaaggcttccttttcgtagctgtcaggcatttcgctgggcacgaccctggtcagataatcctctaaatacagatcattgatcaaaatcagtccctccccttcctttcgtatctcaatggtaccgtcataggttggtgtaccataggatctttggatggaattgacggatatggtatctcctttttccagaggcgcagctacgatccgcccgtccttcagccgctcgtctgccgtatcaatgatcacttctgcctttggaggcacatttacttcctcttccccataggacaatgacagaccgctttcagcagacagggttatggacgaatgaaaaatggactggaagttggtgctcatcaaaagaacccgtatgctctttgcatcaaattcccttaccagtaaagcagcgcatatccttccatgagccacaacaaaatcctgtatgtcatatcctaccagaacatcggaaatgctccgctcttcaaactgtccatagagccggtatactttaaaatccttatccagctttaaactgccatacccttcaacttcaatggaatcgtcctttacagccaggaccttcccggatatcttctttttcttcatggtaaccttttgaaggctccctcttttcaaactgatgtccgcaatgttattggcaaattcctcgggctgtcccaaagaagcctcaaggggaaaggtgcgttccaccgcccctaagtatacgcggaaggttcctccctcacctgtggtcagccagacgtttttataggttatggaatctgtcactgcttcttttaatgcaatgatctcaccgtttcttaccagaagctttaactcccagtctatgtaagaatccaggctgatgccctcaaattggaaatttcccccgctggtataggcggtccaggctgatgcggtttttacgttggtgggagtgccataaaggaatacatcaagaaccttgatctttccttccttatcaagggattctctcaactcatcataaaaataccaccattcatctgccgggatccttttgttctgctttttgccgctctcatgaattttctttcctgaacccggaaccaaagcttccgccaggctttccgcctctttataggtcagaaagccttctgcagtgtctcttttggccggtatttcatcaggatcaagatagccttctgcatacaggtaattcatgtatttcacataccagttattctgttccttttccggaaaatacccctgcttctgatccgtcagcattttttcacagctttctctatctgtaagaaggagagcagccgacttatatgcggcccctcttgatattccctccggttccggttcatttaccagaataattataatgagaatcaaaaccaaaagaggaataccggcaacaaatccgataaatttctttttattcatgtgctcctcttatctcatatatgtttttttatcttcatcgatccgttctaggtcaaaataatctgtcgttttaagggaaaggttctttttcgtcagggaacggttcaccagccttgacaccgcgctgtaaaacaccgcaaaggtgggaacggctatgatcattcccacaaagccaaagagccctccaaaaagcaggatggagaacagcacccagaagctgggaagccctgtggattgtcccaatattttcggccccaggatatttccgtcaaactgctggagcaaaaggataaatatcaggaaatacaaacatttgagcgggctgaccaaaaggatcaggaacgcgcttggtatggctccgataaacggtccgaaaaacggaattacgttggtcacccccacaatcacgctcactaacagtgcataaggcattttcatggcgtttaaaagaacaaagcacatgattccgattatcagggaatctaaaatcttgcctgttatgaatccgccgaatacccggtgaacaaagcgaatctcattgatcgcctggttagccgttttaacgggaagtatgctgtaaatgattttctttccctgggcagaaagggttccctttatgtttaggagataaaccattacaatgacgccgatcaggatgttcttaagaaccagcaccacgcttaacagtccgctggaaaggctgccgatgagcatggacatgttgggaaccagatcagaggtcatccagccttgcagctggcttgtcagccggtcatatatgggaatgaccgcccgctccacagccggattatcctcaaacattttttgaagccacaaagccagatcgttgatattttcgcctaatgtctcctgaagtcccataacgctggtataaatctcagggatgatcatccagaagagtccgactacgatcacaaacagaaaaatgaggctgaccaaagtacccatggcactggatattgacctggaccctctttcatttttccacatggaggaaagcaggcgccttgtaagatctctggacttgttatataccggcagtaaaagatatgcaagtacagctccgtaaatgaccggcataagaatccccacaactaattttgcagttcctttcactgcctggaatctggaaaggaagaaggcaaaaacaatgctcagggcaataacggaaagggctgtgatcccccagcatatatagttccgaaattttgtttctttcattgaaattctcctaagttatttagattgactgttgtctattctatactttaccatactttaccataaagttaaagcagcgatttctcgctgcttttttcttttgtaaccccaaaatgccggttcttacttattgacgcctagccttgctaggtgggcaacctcactcaggtttctgccttccactgcaaacggaggcctgacatccacctgaaaatatcggaatcccatgagtcataatgtaggttcaaaaaaggtaagagtgtcgcacatttcaggaattacattcctatgatttctatggtcttagtatacactacttcaatctgtttttcaagttccttttcctgacagttttaagtttcacgaatcggatcagacagcaatatgtttgctgccaagcagtcttccatgctcaacatacagttccaggagtcctaaaagagaatcacaggattcttcatgaatgaccaattccaacccttccgtagtggccaaagacagtacagacagcagtgattttgcatttactatgctgtctccgcaggccagattcatcttctctttacacgctcccgcaattgagacaaactccaggatggattcaattccccagaatccgatctccacctttttcatctcttgtattcctcctgatcatcgaaatgtatccggcttttatgctatcctgttccggcgttagagactcagtatagcacactataaaagattctgcaaatcaaaaattgtttcagccagaacatctgctccggccgctttaagctcctgctcgcttccataaccgtacagcacccctacagaggcaattccgatttcttttgccccagaacatcatgctttctgtctccgatcatcaccgttttgtccaggtccctgattccgcattcttctaaaacgtagcggatcacatcggcttttttcaccctggtttctcccatatcggcaccgcccataaacgtaaaataggaatccagttcaaaatgcttcaggatcatcctgacaaacacctcaggctttgaggaggccacataaagctttttccccgcattaagaaaggactgcaaaacttctgcaacaccctcatacgccttattttcatacagcccttttcctgagaaatactcccggtaaacgtcgatggcctttcctgcctgttcctcgctaaagccgtaatattccataaagctgtcctttaatggcggtccgataaagcagcaaagctcatctaagttctccgtctcaattccaaaatgacggagagcatattggacggactttgttatcccttcctttggatctgtaagcgttccgtccaaatcaaacaaaaaataatctttattcatggttcctcctgtgtcagtgaaactaaggaaaacaggctttgcaagcttttcttagttgacgcggcattcgcaaaaaacagagacgaaaaaggagatccctttttcgtctctatgaaattttatttcagttcttcaacaattttctgaagggctgccagagcatcatcaggaagtttatcatagccttccttaacagtagcagtatttgcaacgaatttcaccctgtcttccatacgggcttttaactgctccgcataaacggcatcgtcaagatccggaacaaatccttcccattcaaagatctcgatatcagagaacggtccccactgcttaaactgggccgtcttgtccacgatggcctccagaattcccaaggtatcctttggctgaaccttcttacccatgaaatcgccagtattaataatgtaacaatccacgttcttctcttctaccagctttttgaatttttcatagtcattgaccaaaggataggttctgaatgggtttgcatatggaacaactaccagagcatttggatcagctcccggtgcaagacgctctgctgatgatctcttggtcgcaagagtcgcacccataactgaggccagggaagcacctttcagcttgactacaggtggaatggtcggatccttcatgatccagaaaatagcattgaccggcgcatcgatcttatccacacggtttggagaccacagttttgacttgatggcacgtccatttccgtttctgatgtcttctgttaccagctggatctttccgtcttcatccatggtacaggagcagttctgggcagttaaaagatatttattatcttcacagccggtcggataatcctgtgttttatcaaagtatgtgggttctattgccacagatgagcaggtgtcagtattgataatgaatgcatcatcatgaagaaccgtaacatcatattttccgccatgctttgcatgggtaatggtggattttcctgaaccggataaaccaaatacagatgcaacatattttgaaccatcggttaggttatattctttctgtccgccgtgacaggaagcatatccgttgcggtttgcaagagcccaaaccatggtaagggtgccttttttatgctctccgaagtatctcatacccaggattgccgcacagttctggtccgtattaaaatagcacaaacattttggatcgcttaaacaggacagatctacaccgggacggtcagagccgttccactgaggatcagagaagatatagatatcagtttcttttccatcaccgactggcttggaagctttatacatttttgcatattcatcagacatatactggaagttcagcatccagttatacagaatattttcttcgccttccggaataagaaggtgaactttcaccatgaattcagggtcaagtccggcataaacttctgcatgatacattgttttccaacgggtctcataaaccgcatccataaccaccttatccaaagcgccgcaatttacgccgggctctcctgcaattctccttgcggttgcataacgtccggtaattgcaccatcgttaaataagagaactttggcatcccgctcaagaccaaactcttctcccctgtataccggcatatccgttactacggttcccggtgaattctttgccaagtcatatgcctctctaagagtgttaactttaataacattgtttccataaaacggagcttcaatgatcgaacgcgtggttgcaaaacctggtttgccttttccaatttcattgattggataatatgcttttgttgacatagaataatcctccttttataaaatccaaatttgtttctattatctcacttcgttaagaataagtcaatgatttttattgcaattatcccaaaaaatgtatatatttaatatataatttacattatgtatacaataagcaaaagagaggataattatgattcacatttcaaaagatggcacaggagattttaacagcattggagaagcgcttcgttcccttccagccggtcataccggggaacacatcctctacattcacaagggactttatgaagaacagattaccgtaacgattccaaatgtaacctttatcggggacgatgcagaagacaccattctctcctgcggcctttatgcccgcatgaccatggaagacgggatgaagcggggcaccttccggacctattcctgcctgatcgacacccatgattttaccgccaggaatctcacctttgaaaacagcgccggaaagggcgacgacgttgggcaggccatagccctttacgcagacggagaccggttgtcttttgaaaactgccgtttccttggaaatcaggatactctttttacaggcccccttcctccgaaggaaatcgaacccaatggatttatcggtccaaagcagcatgctccccggatcaatggcagacattattataaaaactgttatgtggagggggatattgactttatattcggcagtgccacggcatattttgaaagctgtaccttcttctccaaatacacgggaaaggaaatcagcagctatgtaacagccgcgtccactccagaaggccaggaatacggttatgtcatgacaaactgccgttttgaaagcaactgcccccggacagcgcatacctggggcgcccgtggagggagtatgggaaaaccgtgctgatagactgctacatggatgatcatatctgcaaggaaggctggcatgattggaacaaagatgctgctcatacccataccttttacgccgaatacggcagctttggccctggaggcgtaatgaaggaacggccggactggatccgccgtctgacagaatcccagcttaaaaagttcacaaaagaagccgtcctgtccgggcaggatgactggcagccataaataaatatgggagccaatcccctataaaaaggattggctcccgttttttgatcagttctctttgattttaacaatcacttttttaataaaggccggttcaccggcagctgcctttggcttatggccatcccaaggattgaaaatcatatattctccagcctttactaccacttttaagcctggattttcattgtcgtaaaatacaacatctttttcttcgttataaggtactttttcagccagttcatcgattcgtgcatatgtcatggtttctgaaccggatatcatatattggatatctgtataattatggtgggcttcgtacttggcttcctcccagggaaccgttgtgtactctgttacattggcaaagacattcttgccgtcaatctcatatttgcctggcgccaggctctccaaatcagtgttcttaagaaaatcaactgccttttcgtatcttccatccattccgagatttctgtaaaaatcaaggttttttgctgagtcgaaaatcataatcatactctccttttatgtatcgtatagttttgacagcagactccaagggtacctgccggacacatatagtatacacctaaagcagaatattctacaatgtttttatttaaaaaattcatggttcccatgctgaaacaagtaagtcagatgagaatcaaaccagctcaccgcacctctcctggagcctccccggtacataaaatacagggctccattggagtaatcctctccggccaaagcgcggtcaacacactgtcttgtatcatcagttacttttacggaattaatgctgccgtttgacaccggcgaaaactgggaaggtgcatagacgacccctttcaccgtatccggaaattgtccgctcttcacacggtttaaaattacgttggcaacaagtatctttcctctgtcatcacaaataccggcctcagcctgcacgatccgcagcaatacctgataatcgtcctgagatacggacatggcatgaacggccttttcttcttctgccttctttgcagcctcttctgccgcttttctcgcttcttccgccttttgggccgcttcttctgcctgccgttttgcctctgcttccaaagcgatccgggcattgatccgccgggtctccgcctgggattcttcctccagctcctgcttttggattacttctttttccagaaaattgccggcaagctgctgtgcctgcatccgggattctgtaagctttatctgggcctttgcctgggcaacggtttcttctttcacttcttcctgatccgtgacgtcttctgattccggcgtttctgcaaatgccgttaaagcattcctgccgccgcttccaaatcctgctgaggtaaatgccacaacagtaataattgctgcacccgccatgaaaactgcggaagaacgatacatccgctttgtgaccttaagggtcatccctctgaagaattgacaaatctgctgaaggatagagcgtagtgtaagcatacatacacctctttctcttatatcacttgcctgagctgagggcgcactccacagccgtttcttggtaacgtccgtaattatagaagaagcctgccaaaaaagtcaatggccatttaacatttttgtgatattttaatttctaaatttttacctcctattttgttttgtgtatattatacatataatccatgtatatttttaatctatttgtaatatttatatatgtatattttacaatagtgttacatttatgttaattattgtgttatgaggcaatggcttgtctctctcattttttgttttatgtaaactaatcctgcattaaaggggcaaatctaccctttatgaactcaatcagggtctgtggagagatgacgatctgctgtcctctcagccctccgctgacgacaatttccgaataagaaagggctgattcctcgacaaatgtcggaaattgttttttcatgcctatgggagaacagcctccccgaatgtatccggtaatattctgcaaatctttcatgggaatcatctccaccttcttttctccggcagccttcgccacttttctcaaatccagttctccatccaccggaatgcagcagaccagatatcccattttctctccttttaatacaagagttttaaatacgcttccgtgatccgcccccatcatatccgctgcgtggctgccggataaattctgttcatccacttcatattccctggttgcatattcaatctttgccttgtcaagcatacgcattgcatttgtttttaccatgttgttcagctccttgaatttttttctaattataatacgtatttccactattggcaatgccgggatgtcaaataccccgcagcaggctgcagggtatctgaccggcggcaaccgtcaaaatcagggcttgatcttggctcgctgccattggataagtaaaaagtccgcaacagccggatacagttcctgacaattgcggacgttttttccatggaaaaaccagttactttttcttatttatataaggaaataatcctccggctgaaataatctcctgcataaaaggaggaaatgcctgtccctgaaaggattcaccggtggtcttatcagtgatgataccactgtcaaaatccacctccacctcatctcccgcctctatggcactggcagcctccggacactctataataggaagaccgatgttaatggcattccggtagaaaatcctggcaaaggtctcagcaataacacagctcactccggcgcacttgattaccaggggagcgtgttctctggaggaaccgcatccaaagtttttatttgcgacaataatgtccccttttttcacattggttacaaaatctttgtcaatatcttccatacagtgttttgccagttcattcccgtcggtgatatttaaatatctggcaggaatgataacatccgtatccacgttatctccatatttaaaaacagatccacatgccttcatattttatgacctcctataatcccagttcatccggcgcagagatatggccagtaatcgcacttgcagcagccaccgcaggactggacaggtatacctctgagtccacgtgacccatccgccctacaaaattccggttcgtggtggaaatacagcgctctcctgccgccaggattcccatatagccgccaagacacgggccgcaggtcggggtgctgactacagctccggattcgatgaagatttccaaaagtccttccttcatggattggagatagatttcctgagtagcgggaatcacaatgcagcgtacattttttgccaccttccgccctttcataacagcagcagctatgcgcatatcgtcaagcctgccgttggtacaggagccgatcaccgactgatccaccttaatctcatcaaaggtacccatggtcctggtattttcaggaaggtgagggaaggaaaccgtaggctctaacttggataaatcaatggtgtaaaccgcatcatactctgcatcctcatctgcctcatatattttgaagtcacgcttagagtggtccttcatgtattgaatggctaaatcgtccaccggaaaaattccgttctttccgcctgcttcaatggccatgttgcaaatggtaaagcggtcatccatggacaaattcctgatgccttctccggaaaattccatggacttatataaggcgccatccacaccgatcatgcctatgatgtgcagaatgacatccttgccgccaacccatttggaaggctttcccaccagctcaaattttattgcagaaggcactttaaaccaggctttacctgtcaccatgcctgccgccatatccgtactgccaacaccggtggaaaaagctcccagcgctccgtaggtacatgtatgggaatccgctccaatgactgcatctcctgcaaccaccagtcctttttccggaagaagggcatgttcgattcccatctgtcccacatcgaaataattggaaatttcgtgtctgctggcaaaatcacggcagcatttgcagttttctgcggatttaatatccttattaggaataaaatggtccatgaccagggcgatcttatctttatgaaagaccgtttccttattaaatttctccatttccttaatggcaaccggagatgtaatatcatttcccaaaaccagatccagctccgcttcaatcagctgtcctgcttttacctgggaaagccctgcatgggctgccaaaattttctgggtcatcgtcattcccattgtcgcgtcctcctgttaatttatcgctattgccgttcaaccattccatcataatttggcgggctgaaaacgcttaccaatgggtgaactgcaacatcattttcctgctttacattctaacatacttattgatataatagaaatacataatatgaatatttaatataatagttagttataaaaatgaaaggaaaccttatcatggatcaaaacctttcccaatataagatattttatgaggttgcaaaagccggcaatatttctaaggctgcaaaagagctttacatcagccagcctgccatcagcaaatccatcagcaagctggaggacagcctggaggtggctttatttacgcgaaattccagaggcgtccagcttacggaagagggaaagcttctatataatcatacaaaggctgcttttgaggaattaaaccggggagaactggaactgaaacgggttaaggattttaatatcgggcacttaagaatcggtgtcagcaacaccctttgcaagtacatcctccttccttatttaaagggattcattgagaagtatcctcatattaagatcaccattgaaagccagtccacttcccatacaatcatcatgctggagcagcagcggattgatctgggactgattgcagagcctaccaaccggcgccctcttttatttaagccggttatggatattcaggatatttttgttgcaaccaaatcctatctggataacctgtatttgagggaaggtccggatgcagacctttttcagacagggaatatcctccttttggataaaaacaacatgaccaggaaatacattgatgaatacctcaatgaaaaccatattgttccaaaccagcttttggaagtcaccaccatggatctgctgattgaattcgcaaaaatcgggctggggatcgggtgtgtgatcaaggaatttgtccaggaagaactggacaggggagatttgatccagattcccatggaaatggccatcaggaagaggaccattgggtttgcttataaccccagcggaatgtccactgctatggaaaatttttttgaagccatgagagacgctgggatcccgactaaataaagaatctgcattgcagactcccgtaccaaagcgcggctgcttagctgccataggagtttccatatattatagaagaaacccggaaaaaggcaatcctttttccgggtttcttctatatatatgggctatcgcccgcagctaagaaaatcttagttatcgatcagctttccgccgtcattccagctgtacagcttacgaagctcgcttcctaccttttccaactggtgagaagcctctttttttctaacagcattaaagtgagcacaacccacctggttctccaacagccagtccttggcaaaggttccatcctgaatatctgcaagaacctgcttcattgccttctttgtctcgtcggtaatgatctttggtcctgtgatataatcaccgtattcggcagtattggaaacggaatatctcattcctgcaaagccgctttcaaaaatcaggtccacgatcagcttcatctcatgaatacattcgaaataagcattctcaggagcatatccggcttctaccagagtttcaaagcctgccttcatcagtgcgcaaacgcctccgcacaatacagcctgctcaccaaaaaggtctgtctctgtctcaaccttaaaggttgtctccaacacgcctgctcttgcgccgcctaacgccaatgcataagcaagggccttgtcctttgccttgcctgtgtaatcctgatgaacagcaaccagacatggagttcctctgcctaccagatattcgtttcttacggtatggccgggagcctttggtgcgatcatggtaacatccacattctttggaggaacgatctgtccaaagtgaatggcaaagccatgagcaaacatcagcatgtccccatcctttaaattaggctctacggactccttgtacatggcagcctgtttctcatcattgatcaaaatcatgatgatgtcagccttttttgcagcctctgctgctgtataaacagctaatccctgtgcctcagctttggcccaggaactgcttccctcataaagtcctacaatcacatcgcatccggactcctttaaattaagtgcatgggcatggccctggctgccgtatccaatcactgcaatggtcttaccttccaataaggataaattgcaatcttcctgatagtaaatctttgccatcttttatttcctcctcatatactgactcttgatatatttttgttaaaggaaccctgccgacgactcactgtccgcctttggcaatacctctagcttacaaatccagactgcctatggcagataacggacatcgtcagagcctcttgaaagccctgtaaggccggttctcgcaagctctaaaatttcgtaatcttccagcaaattaatgactgcatcaagctttgactgatctcctgtcagcatgacggtcacggaatccctgcccacatccacaatggtagctctgaaaatatcggctatggcacagatcgcctgacgttcactggcattggcatgtaccttgaccagaataagctccctgtaaacagaatggcccggctttaattctttgatatcccttacatcttccagctttcgcagctgcttttcaatctggtctaaaatctcctgatcgcctgtggacaccactgtcatcctggaatatctctcatccgcagtcacacctaccgtaaggctttcaatattatagccacggcggctaaacagtcctgccacacggcttaaaacgccggaggtgttatcaaccaacaatgataatacaattctctccatccatatccccgcctttttgtatagtaatttaaatgatagcaatccatcatctatttgtcaactaaataataggaatgtgtattataatttgaagttatatctaaaaatacaggttaaatgaaaggccacgcactttccttacgcagccccttttccttccagcttccaggatggcataaagctcttcctttgttatttgttttgaggagtagctgcgcacactcctcctctccaccagatttttaatggtttctttcattttatctgcctcctgtcaaacgtaaaatcttcttattattatatcacaggagggaaaacctacaagcacctttgatcattttgctgaatttcagtttcaggtaatggattcacatgtaccatgcagtgctttacatcgggaaaatgcttctcaatggacagatggacgttctctgcgatttcatgggattccacaagaaccaggttcccctcggcagcgatctcaatgtccacatacactttagcgccgaacatcctggtcctgatatcatcaatctgcttcactcccatgaccgccatggcagattccttcattttctggaccgtttcatcatcgcaggctttatccaccatcttatccattgcatcccgaaaaacatcgatggctgccttgccgataaaaatacagatgaccccactggccaaagagtccagaaccggatagcctagtcttgctccggcaatgccgatcatggctcccacggaagacagagcgtcggagcggtgatgccaggcatccgccatgactgcgcctgaatgtatcttctttgccgccgcccttgtgtaccagtacatccattcctttacagctatggacataactgcggcaaacaatgccaacagtcccggaataacggcttcttccccatttcccgccgcgatcttcttcactccgcttattccaataaccattcccgtagccatgagcatagctgacaggataatggccgccacacattccatacggtcatggccgtatggatgctccttatctgactttttaccggctatgtttacccctatgatgaccacaattgtgcttaatacatcggatgccgaatgtaccccatcggaaatcatagctccggagttggccaggatgccggccgccagcttaaacaccgaaagaaacagattgatcacaatggtgaccattgatacgtgcatggcaatgcctctcggatctctttcccttttccttttaaaaatccgttccataacagttacccccattgaataagatagccttatggcacctgcattaagtccccaatctgtttattttcatatttcgtaacacaaaaaatgcacctgtggaacaatacgagtaaactactgtcccacagatgcatgaaagtcatccgttgtcgcacttggcaacccggccctatagcttataatagctatcgcctgttcagtttgtactgtagatttatgcagtgcaaagagtgtctctacatcttataaaaatagagccagattgtcgatactccgattgaggttttatccatcaggcttctcttatatcatatgtaaccgctggtttaaaatgttacagattttccgggtactcgataatataatattcatatgcattgacaactgttgtacagccatactggtcttctctcttaaagcacttaccataattggcatggacgtgtccatgaagaaagtatttgggacaatacttgtccattaatgtcttaaaacaggaaaatccctgatgaggcaggtccggcagatcgttgagctgatatgccggggcatgggtgaccaaaatatcaaagcctttgtttttcttaagcttccaccacagttttttgatcctccgttccatcccccgttccgtgtactggtttggcgagccgggaatgtattgcatggaaccgcccagccccattatccggattccttgaaaggtcacaatatcatcctcaatgcaggtacagccctcaggaggacactcctcataccttccatcatggtttcccctgacataaaagaccggggcatgggaaaatgtagcaaaaaatgtaaggtaattcgcccttaaatcaccgcaggaaatgatcaaatcaatgtccttcaatttttccggcgaataatattcatagagtgattttgactcatgatcagacagtaccaggatcttcacgctgttcctccatatccgtattttcgtatattgtctgtccctggagacgtaccagagaccgagcttcctccgtaagctcgtcaaatgccggaatctgtccaaccacattttctgtcagccagttcatggtggttatttcctcaggagtaagactagcgttttccttacactggatcttcccatcctgagaataaatgattccttcaaaaggctggaagcttcctgcccgtatggaatttcttaaaaatgcgatcagccggctggtaccgtgaggcagatttttggagcagatgacatcgatcacgtctgccgacattccccaccagtaatttattgcctgctttcccttcatttccttccggtcaaaatccccacggcatatgatgttgacaattctttcatagaatttgccccaatgccagatgggtgtggccaggtttttaagtcgtccatccggattcttctggtaaagcccatattccctggagggtgtctggggagttatcatatcatcccctgaaataaaggtgattccctcttttccaaactctgcctggggctccctgtctctcacccttgaccattctaagtacaccttggcatatggattgatcatccttgctcccagggcaaatgcattgatgtttgcgatgttgccgtaaatgggataatcagcaatatatccgatcttctcatcctgggacatggaagccgccagtgcgcccatgagaaatttcgattcatacatccttccatagtaagtgcagatggaagaataggacatattaacggaacagttgaaaaccgttacctccggatgatcgattgcggttttcacacttaaattaatcatctgggaggcagtggtgaatatcacgttgcacctggcagcaatagccatttcaatggcgcctgcgatctcaggttcggaatctgcgttaaaaaaggctgtggtctgtatggcgccgtcaaaagcctgctccagatgcatccggcccagctcatggccatatgtccagcttgaagtttccgctgtttttgcatggataaaagcgatcttcagcatatgaggttcaatggtctggaacgggcgcagccagttgatgagcttaagaggactgctatctgatgcttcttcgatttcatccggctgttccaccaaagcaatcttattgcctctggaagccagaagaagttcatcctttatcttgaccagatctttttttatttgtccctcgatcctgtcctttacctcatcatatcccaacaactccacatagatgagaaaagcatcggaacatgtcatatcataatcatcaccgccaaaggcatgaaatgctttggaaaaacggtcataggcggatttaaaaacgattctgtcatcctcactccaaagctctcccgtattcttattcatggctttgatcagtttatcatagcttccttctttgctgaaccacacgtcgcagttaaaggatacctgatagaaatccagaaattcgtagtaaagcctgttgtccagattatcgttccgttttggaatcaggcgggtgacagaggctgaaatgctgaaagcacctacatattttaaaacactgacccttttattgccttcctgaacgtaatactggttcataaattcataggctacaattggatcatggattccctcttcaatctgacggtcatacaaatatgcccatttcgctccaaattccgatttttccgacaaaaggggcataaaattactggcaaaggcgctggtgcgtccctctgtttttgtacctaccaccttttccagaggaatatccatgatccccaagctcacttcagaaacaatatccgtataggacagtatttcatcaaggaccggcagatacggatattctccctttgatacggaagcctgatattgtctgcggccccgccttaatgcccccacataatcatataatgccatccgcttttcctccatcttttaataaggctattttagcattaaaacagtcttctgtacagatttaggaggcttaaagtgtctcccagctaaagattcctcaccttaaagtctctttccaattcccttttttgatcctttttagcaatgtcttctctcttatcatatagttttttacctctggcaaggccaatttccacctttaccaggcttcccttaaaatatacctgaagcggaaccagggtataccccttctgagcaatctttgcatccagttttccgatctcggccttgtgaagcagcagctttctgacccttaaagggtctttgttaaagatattccctttttcatatgggctgatattcattccacagacataaacttctcctttgtcgatcctgacaaaggattccttaacactgcatttgcccatgcggatggattttacttccgttccggccagttcaatgccggcctcatatttttcatcaataaaataatcgtgatatgcctttttgttgttggcaattaatttgaaactttctttccccattttacaatcctcctgttattcctcttcaaaatccttcgccggaataaagtcgatggtacgcaaaagcttatccgtacccgccactataacccggataggctgaccaagtttataggttttcctggtcatttcacctaccagctcataatgctcttcatcaaaacgataataatcatcctgaagctgattcacatgaatcaatccttccacagtattgggaagttccacataaagcccccagtttgtcactccagagatcactccgtcaaactcttctccaatatgcctttccatatattcacactttttaagcttaatggtctcccgctccgcttcatcggctctccgctctgtgacagaggactggacagacacctgctgaagtatcttatcgtaatggctgatcctcttttccgttaaacctgcccttaagttctcttttataatccggtggatctgcaagtccggataccttctgatgggcgaagtaaagtgagtataatatttggcagccagaccaaaatggccggtatttgccaccgtatatttggcctgcttcatggaacgcagggccagacggctgatcagggcttcctccggcgtatcctccgcattggctaggagcttctggacttccttgggataaacttctccattgtggaaacggatggaatatccaaaattgttgatcagcgtggcaagactcttcatcttttccggatccgggttgtcatgggtccggtaaagaaaagggatctcctgccagaaataatcctctgcaactgtttcatttgccatgagcataaaatcctcgatgattttagtcgctgcatttctttcataaggcttaatctccaatggctttccccgctcatcaagaatcacctttgtctccgggaagtcaaaatcaatggaacctctctttttcctcttttcccgcagaataccggccagttccttcatctgctcaaacatgggaataaattcctcatattctttcatcactgcctcataatgatcggtcacaatggcattcactgccgtataggtcattctccggtctacgtttatgacggtctctgcaattctatgtcccattacgttgccgtttccatcaatgtccatgatgcagcttaaagccagacggtcttccccttgattcagggagcagattccgtttgacagcttatgaggcagcatggggattacccgatccaccagatatacactggtccctctccttaaggcttcctcatccaaagggctgttttccgtcacataattggtaacatccgcgatatgaacgcctaaagtatagattccatccttttttgatatggtgatggcatcgtcaagatcctttgcatcttctccatcaatggtaactgtctgcaaacttctaagatccagacgtccctgcatatcttttccgctaattgcatccggaactgctgcaacctgtttcatcacactgtctggaaattcctccggaagcccgtatgcccttacaatggaaagaatatccgtacccggatcgttaacatgtccaagaatctccgttataatcccttccggcttccgttctgcccctccgaaatcagtaactttaaccaccaccttgtggccggtcatggcacccatatccttgccctgtggaatgaatacatcctttgaaattttctggttatccgggataacaaaaccaaaattcttatttttctgataataccctatgatctgcccattggcatgctccagcaccttgacaacatggccttccgccctttttccgtttcctggctttgattcggcggataccagcaccgtatccccgtgaagggcgccgcctgttttatcttccggaatataaatatcctgatccagtccttccaccgtaacaaaaccaaagcccttggaatgtccaaaaaatattccggcaatggaacctaagtccggttttccgtattttcctttttgtgatataccgatctttccttctgccaaaagtgtatccagtacctcttttaaatcttccctttgatccttgggaatatcaaaaagcatagccagctcctttaatttcataggcacataggcagggtcttcaaacagctggagaagcatggctttccgctgcattaattgttcttctgtcattgtcttcctctcttaaatatcatttttatctattaatcttttattcttttctttattatccgcactttaccgggaggtattacaaaatcttcccataatgtgaaaaaaacacccttgttaccatacaagagtgttttgtccttacagtatattcagattcagtaccagtgccagaataaaaaacaggactgctccgtattttgtgaatttctccagctttccttccatggaacggcctttatttttgccccagtaggtatctgccataccgccgatagaacccaggccctgactctttccttcctgtaaaagaattattgctgataaagcaacacatatgataacaaatatgattgataaaataatcctgatcacgtttccacctcctatagtcaaacacaggttatcataccataatttttctgaaaatacaatatatttttatattttaatattcattggctcatataacccagcatcaggtccctgaccttaatctgtatccaaagattttcttttaccactttctgctgcgtcttggaaatgatcacatctcataagaaaactctctctgattttttgaccttattattaatagaagcttcttaatttctcaccctcctttgataaacattcaactcttttacctgcaggattttttataagctgatttcctttgtctccaccccgcctatatccttattctttattcttcctccttttgcctgtcacgctccaggtatgtctttccacctttccatgttcctgactcccggcttatccggacttttagagaatttgcttcttccctcttactttatattgaaatttattgattgaaaatactccggcataagaagcaaagaataaacaggtacctttcaaaaattttcttgacattttcatcaggtaccattacaatgtatttaaggtacctgattaactttcaaatttaggaggtagttattatgatggaagataattttacagagctttacgaaaagctctcaaggcttcaatggcttttacagcgtcaccatttacagcaacatgcacagcacggccccatggccgatccaacccgggggcaaggcagggttttggcaatgctcaaaatgcaatcggaaatcagcacaaaagacttgtcttatctgctggggattcggatacaatcccttaatgagcttcttaacaagctggagaaaggcggttatatcacccgcactccttcagaagctgacagacgcgtcatgctggtacagctcacggaaaaaggaaaaaatgagcagcagccccgctcggattttggagatattttcaactgcctcagcgaggaggaacaaaccttattcggtgagtatctcgaccgcgtcatcgcggcacttgaagcccagcttggggatgatgaggacagcgaaaggctggaatggcttcgctctgcccgtgagaggatgggaaatgaacggtttgagacaatgtttatgcatggcggccggcacccgtttggccgcagagaagactatcatggctggcagaacagaaggccgggagattctcatggcgccggacattttgaaccaggctgcaatgatccaagactcaacggacacggaccaaatttctttggcaggccgacgcctcctccgcccaaaactccccacgatgacgaagaataaataatgatacccagcaataacagcattggcgctgtctttccaaaagccatttggcagcgcctttatttttttgcgccttttttcaggcagaaaggagttattatgtcttttattatacttttcatttatggaataaaccatctcatccgtaccatgttcgatcaaaaagaaggggctgccaatgcttagaattttgaaacggctgcctcctgtaaaaaccatactggccattatgttcctgcttatacaaacgggaagcgccctgtatctcccttatctcacggcaggcattgttgacaagggcatcgcagctggagacatcggctatatctggaggcagggcggccttatgctgatctttaccctttgcagggcttgaccggagttcgtgtgatccgcgcatttgccaaggaagaggaagactgcagaaagtatggggaaatcaatcgtgcttatacccagaccgctgtcacggcaggcaccattatgagcatttttgtacctttgatcaccttgatcctgaatatggccaccttagccatcctgtggatcggcggaagccgtggggcctccggaaatttggaggtgggcgcgatcatagcggccattaactattccatgcaaatcctgataggttttggactgctgaccaatgtcatcctcacactcccccgcggccaggtatcggcaaagcgtgtttatgagattctggataccaatttaagcattatggacgcccctgaatcagaaacaacagatggctgttcctccctttcctgtgaacaggtgagcttccgctatggaggtgcagacaatatatcacagggacaaaagcagcttatcaccattgcccgcgcctttgttgctgatccggaaattatcctccttgatgaagccacttccaacgtggacagccggactgaaatggtcatacaaaaggccatgtggcaattgctcaaaggacgtaccagcttcgtggtggcccatcgcctgtcaactatttatcatgccgacagcattgtggtaatgcaaaacggcgacatcgcagaaaccggcactcacaatgaactgatatccaaaaacggcatttatgctgatatttataacatccatttttcaggcaaaacagcataaatggttcaggcagcggctgtaaaaacaaccgctgccgagtttttcgtaaaatgccgcttttcctcttcatctttcacggcccgccattcaaacaaattctgcagcgagcctgccttccacatcgttccaaatagcagaaagccgatcttctgcctcccccagcgtctctgcccgggtccctatataaatcttgaccttgggttctgtgcctgagggtctgatacagatccagttgtcctcttccaacaggtaatacaggacatcggaccgcggaagtcctgtccgcgctcttgttccatccttcagtctgattttccaatcctccctgtagtcgtaaaattccactgttccaaatcctcccactgatttgaatggattacgtctcagctcttccaacaggccggtaatttcctccgatccctctggccctgcctttacaatggtatggagactttctctgtaacatccgtatttcttataaagggtctccatttgatcccatagggtcagcccctgacttctataataaactgccgcctcgcatagggtcatgacagcggataccgcgtccttatcccgggaattagtgccaatgaggcagccataactttcttcaaatccaaagagatactcataggttccctgttcttcaaaaagtcttatctgttctccgatgtatttgaaaccggtcagtgtctcaataagcgttaccccatattcacggcaggcggcttttgccatttttccggaaacaatggtcgttacaacagcaccgttttggggcagtgtgcgtttttccttcctgcggctcaaaaggtattcacagataatcattccggacatattaccggtaaatgccatgtagtcaccggtttttccctccttcgcatacacgcctaaacggtccgcatcgggatcagttgccagcaccaggtcagcatccactttccttgccaatgcaagtgccatgacaaatgccttttcatcctccggattaggagaattgaccgtaggaaaattgccgtccggctgttcctgtttctccacaacatatactttttcaaatccaagctcttttagaattctctttaccggcacgtttcccgttccatggaggggggtatatacaatttttaaatccggtgcacctttttttaaaacttccggctcctgcaccagaactttcagagcgtttatgtaacaggtctccatctcctcaccaatgaatcggagcagtccttcgcattgggccttttctctgcacatgctcttaacgcaggaaaagtcggttaccgccctcacctcctggagaatctccatatctttcggccatgtgatctgtgccccatccgaccaatagaccttatagccattatattccgaagggttatggctggccgtcaccacgattcctgccatacagcccagttctctgacggcaaaagacagttccggcgttggacgcagatcatcaaacagaaacacctggattccgttggcacagagacacagagctgcttccatggcaaactctccggaattatggcgggaatcataagcgattaccgcttttttctcaccttcctgccgcttcatataattggcgagcccctgggtggcttttctcacggtatagcagttcatccggtttaatcctgctcccattacgcctcttaaaccgcctgttccaaactccagctcccggtaaaaacggtctctgatctcttcctcatcgttgaggcccaggagctcttttctcgtctcagcatcgaagtattcatccctgcaccatttctgatattccttcctgtaatcactcatcactgcttctccctatctcatagatgctccttgcatacagcccctccggtccgccgtctgcaatccgtaccttttttataccggaatccatatcaaaataattatcagaaaggagcagatcaccggctctgtttccaatctcaactccctttgcatacgcctcagcttttacaaaaatctcgtctccttccgtccaaactttcagttttgggttacaaaacacaaaatgcttgggcggcacgaacaggctgaaaccatgggaaaccaatacctcctcctgatacaggctgtaagacagatagcattcccttccgtccatttccgagaaatccagcaatgggagtttttctactgacaaaggagcgatgcgggtctcaaactttccctgtttaagcacatcggaccgggaacttctcagactccagcaaacagccccctgaaacggtactctggtttcgtttgttacataaaaacgggcagtatttcgaattgtccggttttcttcgttcacatccattgaccctgttaaggccccttcttcctcgcaggaaagcaggaccggtgcaaaaaagcgcctggcgaaatagtgcagcgccttccaccttccgccgtaatcaatggaagaccaggaagcggctggccagcaatcgtttaactgccagtatacacagcccatacatctgccgcggttccgtctgaaatgctccactccataccggatggcctctgcctgtagaagctgggaaacataaacaatgtgtgaaaatgactccggataccggtacatctggctcatatattgaaggatttttccattggccccattatttctctgatgcttttccattacataggaaaatatgtttctatcctcagcctccgtaaagctttcaattgtttttagggaaggaaacgactgaaagccaaactccgaaagatagcggaaataaaatttccggtattcagtaaaaggtacccctccgtgccatacctcccagtaatgcacgtccccgcggtccggatcattgggaatatcaaaatcaccgccggatgacggactggagggccagtaaaaggtatccggatcatactgctttaaaagttccggtataatcctctcattcataattaagtattccgtcttctgaacgggctttctgatccactgattggcggaaataaacatctccatctcattatttccgcaccacagcccaaggcagggatgatggcggatccgttttacattgtcccggatttcggctttcacattctcttcaaattccggtgtaagaggatagattgcgcaggcaaacataaaatcctgccagaccacaagccccagttcgtcacaaaggtcataaaaaaagtcatcgggataatatcctcctccccatacgcggataacgttaaaattgcattcccggcaatgttccagcagtttttttgtccgtacccggctgactcttcctctgatacaatcttccggaatataatcggctcccatggcaaagatctccactccgttgacctcatgagcaaaccgtcttccgtattcgtctttatccgtgttcatttttatggttctgaggccgatttttctgctccactcatccaggatttcattcccctcctttaaaaccagctccacaagatagagaggctgttccccatatccgttgggccaccacagctttggctggggaatcgtcactgttttcggagaatccggatactccgtaagcgttccttccggatccataactctcacatcccaagagtacacgcattctttgcaaaaggtttcaatctccggatatatggaaagcaccacagcctcctccccgtgtgactgtctgatgtgtgcgccattgatcaccgccctttttgcaccgatcaatgccacattccggaacaggcccgcatcaggaagcctgggcccccagtcccagccaaaagaacagtgagctttcctcagaaacgggaaacccttcatggattccggagccccatcatacggatcttcctcatacgcctttcggataaaaggaaggggcgagtgaatcagaacccggattttattttccgccttcaccagctgctttaccggatattgccagatccggtgcatattgtccgcctgtcccaaataaagcccgttcagccagatatctgccagcgtatcgattccctcaaaccgaagccagattgtttcacactttgcgacctccttttccagggttacggtaaggctgtattcataatccgcctccatcatggcaagcgcctgatcctcccggtccctccagtatggatcttccatcgctccacattccagccaggtcccgaaaacggttccaggcacttttgtatcaaaacacactccggaagaacagtctctgagcttccagccgtcctctaatttctgtattatcattaatatgaccattcctttcatatatgccaggctgattcacatcgtttacatggatctgctcaccattgacttccctaggattgtcctccattgtttcagaaactgacagattgttgatgacgtcaaaccgaaacccatcgattcctttttccagccagaagtcaagaaccttgtatatagccttctttacctggggatttttccagtttaggtccgcctgctccctggcaaaagaatgataataatactgcccggagtttcggtcatactcccatgcgctccctccaaaaaaggattcccagttgttgggctctcttccctccacccatatcggctatcaccttgatcccaagcttatgagcctccttcaccagccgtttaaaatcctcgattgtcccgtaatccgggtccacatcgcagtaatctgaaacgtcatatccgttatccactttgggagagggataaaaaggagtgagccttattccgcccactcccagttttttaaatatggcagcttcgagaggattcccggaatgtcgcccactccatccttgttgccatcacagaaggacatcatataaatctcataaaaaacagtatgtctccaccactgaaccatttattttaactccctcacagaatctctttcgatcagctggacatccaataccagcttttccaccttttcctttggtttttccatgcattttaacaggcattccatggccttcttccccatcagcactttatccaccctcattgtggtaatgcggggagccaccatattgcttagttcaatatcatcaaagcccacaatgctgatatcatccgggacctttaagccgcattgggacaaggccttgcacatgagaatagccattttatcgttggaacaaatcagcgcatccggctgttcctcaagggtctgataaaatgccgccagacttgccgcatcctgattgatgaccgcgtcctccaccttgctcagaacagaatgccttctgatataggaaatcccctcttcaaaagaaggaaaatccagatgctgctgcatggcctcctgataaccccaaaaacgttcccttatgcttggcgtatattttaaatcgccgaaaaaaccgattttcctaaagcccttatccagcaggtatttcgtcagcttataggctcctgccgcattgttggtcattacgcagtcagtaggcgtttccacggactcatgatccagcaaaagaactggtatggcatagctcttcagccttcttaagtactcttcgtcgatctttcctaccacaatcagcccggaaaccttgtgctgctccacacaggccggtatttcatgatttttttcaaaggaattgatgaacaagtcatacccggccttttttgccgcctcttccagtcccaaaagaattcttccgtaaaactgcatatctttaaagaaacggtcttccagaaggatgcagatatttttatttgaataggaggctgtatattttgcactctggtctaaatatcctgtctcttcagcagcattcaaaaccagcctcctcgtctcttcactgacgccggcccggtcgtttagtgcgagggaaacggcattgatggaaagattcagtttttccgctatttccttcatggtaacccgcttcttcatattacaatccacctttctcgtttaaagcgctttcatctcggccaacagaccgcttacggaaaaatctgcccggcatatcttatcatcagcagcgccatagtaaagggagacgattccattctccacaaagcagccacaggtaaagaccacgtttccaaagaatccatctgtctcataaatggcctcaggctccagaataggctcctcagttttcgccaggaccttagtaggatcatttagatccaaaaggaatgcccccaggcagtaacggttatttctgtcggcggcgtggtaaattttcacccagcccatttctgtcttaaaagggaccgcacctcccccaatccggccattatcccaaccgcccccatgggaaattccgcagaaatgcttttgacggccccaatggatcagatccggcgattctgccagccacatctccgggttgccgatcccgtttggaaccgggcggttgaatgccatgtacattccgtttattttttcaggaaaaatcgtgacatccttattctcaggtgcaaagattatcccatgccgccggtattctttaaagtcttttgtactgatcagtgaagtggcggcaccgtttttcgttacggaagtataattgatgtaataagtctctccgatctgcgtaattcttggatcttccattccccagctttcttcctcagagctggggaatgcaaacggaacatcatcgatagcgaaatgaatgccatcctttgacctagccacccgcagatgggacagcgaggttaagtataccgttcgctttccctgctttgtcatcttgttaatggtcctggaatccgtaaaatccagctccgggtgctccgccttgctgatatgaatcacagcgatctcatcctttccctgaacctcctcaacaacaggaacaagagcctcgtcctctcctgctcccctaacggattccgccactctgcacagtaggatcacctcatcctcatattttgcaaccccacagttgaataccccctctaccttgaaatcttcccggctgggctttaccatttccgggaaaagaagcggattttcggcacatctttttacttccagcatgttatttctcctatttttcttaatagattcacagaaattttaagccttgctttttaatgctttccattcccgtattttaaaaaccaaagccatttgaatatccttactgatttttcaaattatcttatttaagcataaagctgattccctctttaaaatatttagaaaaacacaagaacagaatgatgatgggcagagtgagaatcacggatgccgcatacataggtcctgggaaagcacccatgggtttgaactgtgtggaaatcagcacgtttaacgtctgcatttgaatattcggcgcgatcagcatatcccacatcagttccgaccatctctgcatgaagatggataaaaatacgatggtcgttactgactttgtcaccggaaatgcgacgcggaagataatccgcaattctccggcaccatcaatcttcgctgcttcaaatatttcatctggaagcgtcttaaagtagttgatatacataaaaatagcccagatggagatgcacattggaatgatcatgcctccatacgtattcgccaggggttttgcaatcatatatctgggaaccaggaggatgatggtcgggaaaaacatctggaacaaaagagaatccatgatgagccggtctcctctaaatttcagcttacacacggaatatccgttgcacaggccgatgataaccgaaataatggcagtgggaaatgccaccagaaatgaattgaccagtgctctcacccacatcatggaattcgtagcccctccttttccgatcaggtattcatagctcctaagtgtaaatccatgaggagccatcaccttatcaacctggtcccaggcagtaaatgactggatcaccatataatagtaaggaaacaaagatattgccagcagcgccagagtgaccgctgttatgatacaggtttttacgccgaatttcttttttcttcccatcttatctcctccttgttataagcaggctgtattacagccgcctgcgcgggatccatgctgcattacccagcatggtcttaccagccaaacctcctgttcaaccggtctgtgactccattgataattctcagagttataaaaatctgcaccgcgctagcgatcgccatagctgcaccatagccggactggaatctggtaaaggatgtgttgtagatttccagctgccaggttgttgtagtcatgtttggacctcctcctgtcagcaggtagggttccgtgaaaactccgaatgccaggccggtagccagtacaataaccgtggtcagcgtaggcataatcatgggaagtgtaatatggataagcttgtgaagccctgtagaaccatccagcattgccgcttctgtcacatcatctcccacattctcgattccagaaaggatgaataaggcgtaatagcccgacattttccataccacgattccgaccataacggcaaacgcaaccttctgatccgtcagccagtttacggtgagatcaaaatgctccctcaaaaatacgttaaatgcagaattatagttaaagaaatactttacaaccacgctggtagcaactcccgacgtcagatagggaatgaaaaacagcaccgcaaccaggcccttgaccctttccggaaggttggataccagaagcgctatgatcagaccgccgaaaaaacacaggagcacgatgggtactagatagcggtaggaattgataaatgccgccctgacccgggcatctgaaaaaaggttggtaaaatttcttattcccacaaacgtcttctgctccgccatcagattccagtccatagcagaaagccagactgcccagaataatggaatcaggaaaaagatgagggaataaaccagataaggggcattgagcagccaccccataaatccgctcttcctgctgcccgtaatgctctttctcttcataaaaaccattctccttttttacaaggggacagaatacaggtcctgtcccccaaaagtcccgttattccaagcctccggcctgtttcatcgcttccatagccgattccacataaggagtggcatccggcgcatttcccggttccgctttcatcacctcattcatatatggtgatgttccgctttccgtcagcgcagtttgaatatcagttaccttttccgttgcaatgctggggatggaatatggcactgcctctgctaaggctgcaagctccggatactctttcatgacatctgcaaatgccccgttgtcatttaaatcgccgcggacaggaagcatggtggtcgcattcagccagtctaagtcagtctgggcagaattctccttgttgtaaacccatttcacgaactccaccgcacccttatgttcttcttcactgatgctcttattattatagaaaaccaggcccttggaatcagcaaaattataagggatatctccttcgtttttcacaaccgcctgtccataaatgtaatcttctccgtaaactttgttattttccctgtaaagagaaatttcccatggcgcattgatggtgaccagtacggaaggattggcttctgtccagatactggaaatttcgccggactgaatggaattgccgaacagaccaattaactcaaatgcctggacagctccctctttgtcaagcaccagcttattgccctcaacccatggcttaccgcctgttaatgcctcataaggcatctggaaatcataccatctgtcccaccactgatccggacgggttaaggatggacggtaaagggaatgggtaactcccatctctttcatggtcgtatccctctgtgccgcaaactccttaataactcccgtaaattcgtccacagtctttggcgcctcctcaaatcccaaggccttaagagccttcaaattccactgccatatcatcggattgacatacacaggaaggacatactgttttcctccaattgaccagttggtgattgtttcttccatcttcctggccccgatcacttcattaaaccattcctccccggacaaatcatagactgcaccggaagcagcaagggttgctgcaaatccccggttgatattctcagaagcagcaggtatggttcccgtggcaatggcgttttgaatcccagcttcagaggaaggagattccggcatctgctgaaccttgacttccacctttttcccgtctattgtaattccggcttcattaaacgcctgagccttggattcccagaagttatactgaacctgctggggagccgtccagaagtccaccacaatccctcgatttaagctgcttccatttgccgccgccccatttccgcctgattttccgcatccagccaggatcgttgccgccaccactgctgttgttacaattgccaccgttcttttcttcatatctttttctcctcctatttattttcatattcgtcaaatggatcatcaatcatagctttctgaccttcggcatccccaactccgcagtacaactccgcctttccatttccaagtcttaacaagccccctgaaaaaataacgtcctccaggtccggccgcttactcggtcccggctggaaatgttttcgctgggcgatcattttcattgggccatactccccggtttccggatcaaaacagaaggcagtcgcatagtagtgccggtttccttcttcatcaaaccgtgcaatatgagaaagcactcctattttttttccggatatgcggtgaagctggtttgcccctccccattccttaagtatgaactggtcttccatgagaacagactggtttaatttctccggggtcagttcctctaatccatcaatcaaacaccagcctatttttccacggccgccttttactccctgaggccttgtaaacaccagaatttttccatcctccatttcgcaaagacggatatccttcatccggtctggaccggcggcaaaccgcaccatattccatatcccgttacccttgtaaaatacggtcctgtaattcagacgtcccggattctcttcatcatcaaagatttccacacctccaagaatcagctctccgctgattcttgttacaaatgggtcctggagaaggatgggttccgtttccgcttctacccactcaccatccctttcttcaaagaaaccgattctggagtattcattgtctcttgcctccactctccccgcaatccatacttttccatctgacgcaaacggagaagtaatattataaatgtcttttttttcgtgcttgagcgcaaactttattttacttgaatttacttgaatttttcttttatctaattcaagctgtaactccttacaggtccgcattgttcttgcctcttgttgtgatatatgcatgtttttctccccctttgtcttttatttttttacaatttttgcccatttattttgtttgtggttttatactagtcttatttttacttgaattcaattaataattacttgaatttaatagacctataataaagtgattcgtcaagcggatattcgcaatccgcttcgctgcctgtcaggtgcttctctgcccatttactaccgtctaaaaccttttctttctgaacattatcagagtacggaaaatgtctccccatttctataaggcataaaataattttcttttccaacaatttatggcataatagatcgtataaatacattagcgaaatgtctctcattccttgtttttgattattgtctcaaaaatgcggctgtagtttgtccaaattgcagcaaggatcagtcgaatccatgccatacctataaaaacaggaaagacgaaaaaggtgatgcaatgactttacaaaatctgaaatatatcattacggtcgcagaaacagggtccattacagaagcagccaggcagctttttatttcccagcccagtttatcaaatgcaatcaaggaagtggaaaaggaagtaaaattctcgattttcacaagaagcagggctgggattgctttaacaaatgagggcatggagtttattggatatgtccgccaggtgattcagcagatggatttgctggaagacaaatttattacaaatcttccgaaaaaacaaaggttttgtgtctccacacagcactatacatttacagccaatgcctttgttgagatggtcagacagtttggacaggagcgatttgagtttatattaaatgaaacacaaactcatcagattcttgaagatgtaaaaaaccgttttagtgatttagggatcatttatatcagtgacagcaatgaaatcgtcatcagaaaagaactggaagataataaacttcgcttctttgaattgtttactgtcaggccccatgttttcctgcgggcagagcacccattagctcatagggcttctgtgaaattggaagacttaaggaaatatcctcgattgaattttattcagggaaattacgaatccgcttatttttctgaggaattatacagcacggtgccatcggaaaaaagtataaaagtcaacgaccgtgcgacagtcgtaaatctgatgattggtttggatggctatacgatttcaagcggtattttccccaggtatttgcaaggcgatatgattattgcgattccattggatgaagatgagcgtatgtgtatcggctatatactgaatgagaatcaggaattatccgagttagggcaaatatatattggggcattaagaaaatataaaggaaaataaacatagtctcaggctatggaatagcataaaaaataagaattagctatcatacatcctctcatggtattcttaacgaaaaatgaaaaggatgtattattatgcagagctatgttttagttaattttttcatttatgtgcttatcaatgctttcacgccgggcccgggaaatatcctggctcttaatacggttacaaactatggctggaaaaaagggaagtcactgttctttggaatttttaccggatattattcagtgcagacgatttgtgcagttttcattcatggtgtcagctcactgctgccaaatattctgggaattatgaaatacgttggtgctgcatacattctgtggctggcaattcatattgcaatgagtaaagccagcgaaggtgaaacagaaaaatcagcctcttttttaaaaggctttatgctgcagttcgtcaatgtaaaaatttacatgctgggcatcacggctatgaccggatatataacagcatacagtacttcttttcctgtgcttttaggatttgaattaatcatagccacaataggagttattgcaaccgtcacatggatcggtctgggaataatgattcagagagtatatttaatatatttccgtatcatcaatatcatcctggcagttatactgctggaatgtgcgtatagtatgataaaatgaaataaactgctgcttatccaattaatgaatcagaatatgtgatagggaggaaagtatatatgcaggaagtgacaataagaaaagcaaataatgcagatatgagcgatataatgaaactgcaggtaaatgtatttacaggagaacaaaaaattcctgaaaatatgattgaagtaactggagagagtcctgttcaatggtggtgtgctgcaatagaatcatcggttgtgggagccgttgccgcatggagagagaacaatcagattcattggggaagatttgcagtgaaccgcagctgtagaggaaaacaaattggtacctcgttagccaggcactccctggaagctttgttttcacagggggccgaagaagtatacatggaagcacgggatgccactgtagcaatcatttgcggtatgggaggaaaaatcattggcaaacctgtttccttttacgaagggactgtgacgccaatgatcatatccagggaagattatcacaggtaaattggcatttattatacatataggagacagaaatcctgaaatggaacagcatttatatgactaatcccagccatttgtttctggatatggatgcagaaaagaagtctgctgcgcagactccttttccattaaggaattaattgcattgataccatcgtgcaaggttctttttgacacatgatagtgctggaataacagatccggacttaccttactgtcagataccagataattgataatccatacgattctctgattcatcccaatgccctccgacgaaattataattccttatctgggtccattatagcacctgatatcccgttgattcaactgattctttttttcggccggtcagccgaaatattccgccaccgctcgtcccggcttccggtaaaattcctcaatgcgcagaagctcattgtatttggctgtgcattcccctctgcagggtgcgccgctcttcacataatcggcacgaacagccgcagccatatcagcaaggaaggcctcctccgtatctctgatatcgctggcaatgatcaccttatgtccggcttttctcgccttttctaccatttccagtgcccctgtaacggtccctgcctgctccatccggatgatcgtggcattagcctcagtaaaatcatcggataccataagggcacggtgctccagcagactcatcatttgttttctcccctctatgtcttccttccacagtccgtttatgaccgcgcagatggggaatccatctgccagtctcatgtaataggcgatcatatccttttgctccctgtttatggagattccgccttttttgctttcttttgaaaaacaataggtcccctcttcttttacatacagctggtcagctcccgcattgatagccaccagcacatctgttcctggcttatatcctgtaagctgaaaggaatccatcaaatagtggagagcttcctctgaatttttcatatccggctcgaaaccgccgccatctcctgtggaggtgctgaaaccgctcatggctaaaagcctctttaaagtctggtaaatctccactcccatacgaagcccttctgaataggacccggcgccctgaggcacgatcatgatctcgtgaaagtcaaggcctttttccccgtttcctccgcttatcatgctcatcattggaaccggcatcacaggagccgaagttcctcccagataacggtaaagaggaaggtgaagccctgcgcctgccgctcttgcaacggccatggataaagccagaacgccttgattcctgttctttcccgccccattctcctccgatgcctgctggagttcccggtcgattcttccctggtccgatgcatcctcaaataatataatttctgaaagccggtcatttacaatctcagcctgttcttctgccctgcctgtatttcccagggaaactgccgctctgccatgtgcgccgttttccagcaccacctcggcctcaactccgggatatccccaggaatcccgaacagtccttcctgttacttctataatatcaagttcgtttaacatggttatgcctccctgccctttcttgcattcttaccgtaaggattgacggaatttaccatatccatgcaagtacaacgaaaaaaaaaatgccgggatgaaaagcaaaatttgcttttcatcccggcatttttcctatctttcaaacagctcttatgcccgaagttggattcccagtccctgtaatccgttaaggatttttttcatcacagtaagaacttcctgctcctctaaggtatgatctcctgcccggaaagtgatggaataggcaacagacttatatcctgataaaatctgtgatccttcatagatatcgaaaagctcatagctctccaatatctttcctccccgctgttcaatgacctcttcaatctgtccaaccagaatttcttttggaaccaccatgctgatgtctctggtaacagcaggatattttgcgattccggtgtatttccgatcaaagcttgtaaacggtatcatggatggcatatcgatcacagccacataagcacggtccccgattttataattatcagccacctccggatggacttctcccagatatccgatggtcaccccatcgtaaacgatatctgcctgtcttcccggatgaaggaaggttttcccgctctttggatcgtaatgaggctttttgtgcattcccgctttatcgaaaaattcttcgatcactcccttcatatcgaagaaatcgccgtctccgtaaaagcccagggtaaactgcattctttcatcaggaagctcagtcaatggagagccttgggaagataaatattggcaagctcataaaggcgtacattcttattccggcggttatagttggtggacaaggaatttaacatcccatgaagaggggaggttctcataacgctgaaatcttctcccaaaggatttaaaatattcactgtcacacgaagcgggctttcctttggaatgagaaggcggtcaaataccttgggactttcaaaggaataggtcattccctgggaaaatccgcagaattgtgccacttctcttgccacttcttccacccttaatttataggacagttttccggtagttgcttcgcctgttggcagggatacggggatcttgtcatatccaaagaatctggcaacctcctctgccaaatctgccatacagtctaaatcctggcgaaaggtaggaatgaggatctcgtttgacatctcatcgtatcctagatccagctttttaaagtatccaagcattgtctccggctggatctcagttccaagaagacggttcatcttttccggctcaaaaggaagtctttttccctctctctttgtgggataaatgtcgatcatgccccctaccacttctcctgcacccagctcttcgatcagctggcaggcacggttgatggcttcctctgcattattggggtcaaggcccttttcaaatttaccggaagcatccgtccttaatcccacctttttagaggaaaggcggatattggtgccgtcaaagcaggcgctttcaaacaccatggtcttcacctcgtcagtgatcttggagttctcgccgcccatgatgccggcaattcctaccgctttttccccatcattgatcatgagaacggtgccatccagctttctttcctgtccgtcaagggtctggaaggtgtccccttctttggcacattttacaatgatctcatggtttgcaagaagatcataatcaaaggcgtgcatgggctggccatactcttccatcacgtaattcgtaatgtcaacgatgttgttaatgggacggattccacacgctgcaaggcgtctctgcagccagaccggggagggggccagcttaatatttttcaccattctggcacaatagcgagggcagagatggctgtcttctacggatattttcaaatagtcattaatattctcgctgttgcctgtagcattcaccaccggaggtacaaagggtttttgaaaggtcgcggcggcttcccttgcaattcctataacgctgtagcagtccacacgatttgaggtgatttcatattcaaatacagagtcatgaaggcccagcacctcaatggcatcagcacctgttttcgtatcctcaggcagaatgtaaatcccgctttccggagcatccgggtacatttcactggaagatcccagttcctcaatggagcacatcatgccgcaggattcgattcctctcagcttcccctttttgatcctgatcccttcttccggaagagggccgccgtcatggcctccagccacctttcctccgtctaatacgaccggaaccttatcccctgtctttacgttgggtgcgcctgtgacgatctgtacgatttcccctccaacgtccacctggcagacgattaatttgtctgcatccgggtggcgctcaatggataatatctgtccgaccacgattttctctaagtttttatccaggcattcgtagccttcaacctttgatccggtaagtgtcattgcgtctgtatattcctgaggcgttacatctaaatccggaacgtatgctttaatccatgataatggtgtattcattgatctatctccctttccctaaaactgctttaaaaatctgatgtcgttctcatataataatctcatgtcatcaatttcgtattttagcagagcaattcgctccaatccaacgccgaatgcaaagccggaatattcatttggatcaattccgctcattgtcagcacgtttggatgaaccatgccgcagccaaggatctcgatccagccggagcctttacagaaacggcagccttttccgccgcatttaaaacaggtaacatccatttccgcgcttggctctgtaaacgggaaatggtgaggacggaatttaacttttgtctccaggccaaaaagctctcttgcaaactccgccagggttccctttagatccgcaaatgtgatatttttatcaattacaaggccttcgatctggtggaaggaaggagaatgggtggcatccacctcatcagaccggaatacccggccgggagccagcatgcggataggcagcttgcccttttccatggtacgcacctgaaccggtgaggtctggctccttaacacgatgttgtcactgatataaaaggtatcctgttcatctcttgccggatgatttttgggtatattcaacttttcaaagttataggaatcgtattctatctccggcccctcaatgacctcatatcccatgccaacgaagattctctccacctcttccagggcaatggtattgggatgggtgtgacctaccttgttccgtttagccggcagggttacatcaatcacttcctttttcagctgttcttctctggcctttttttggaggctggacatggcctcctctaatttaccctcaatcaatgtcctggcgtcattgaccatctggcccacttttggcctgtcttccggggcaacatccttcatactttttaatacactggtcagctctccctttttcccaagataagcgaccctgatgtcattgagtttttccagcgcatctgaagcgtctatctgcctcaatgcttcctgcttgattttttctaattgatctttcatcctgctctccttctttcatgatcaaattttgtttttcccgcttaaacggcaaaatgcactaaaaaagctccgccccaaaaagggacgaagcaatattcgcggtaccaccctcattcctgtgtatgacacaggcactcggcatacgtaacgtgtattgacgtcatgacttacccgccaggccggcagccaaggctgtctgctggtttcaatcatgctgcttcggtgggaaattcgatctcttatctgaacttaaaagggcttgcagccggcggccccttctctctggaagaaaataaggatttacttacaccttcattgcatttgacatttttaattgtaacgttaggtaccattgtaataacggttgttcaaaatgtcaaggattattttacatggattatctcaaaaggaaataagcggccacaaaaacagccgccagcacagcaatgctgattgccgcagaaacataaggattcctgtcattggaaacccttaccgtctcatagtcatcatcatcatggcgtttgctcctcaccggctttttctgttccccctccggcccgcgcaattctctctcgattttcatgcgaagaagtacttcttcattggctatgtgattgcaataaggacagtaaatattgttgttatcatcaggtatctgattcccacagtggggacatactttcatgatctgtcaggaactgcgttacaatgccagtccctttccccctcccatcatatagtagatataattataccatatttgccatatattttcaatcgcttccctttccatagtatttagattaagcagaccatctgccctttttcttttctcaaatcgcatccttatatgtttcttccaggatgcgtttaaattcaaggagtatttcatatgtttccgcccgtttttccaggtgctcaataaaaatatcaatatactccttatcttcggctcgtttgatcttctcgacctgaaccttttctttttcctttttataaaaatgaaccaacaaaattagaagcgcactttcaataaacagcgcacccaccaaaataatatctaaacaactcattttttcccccttgttctttaaaacataacatacaactattatttgtactgcttttcacagaatctttattttaaaacctcatccatatcccctcccctgatccgtatactgcaaaggaattcttgccggcctgaaagaagctgtttccctggccttcattgtaacttcagacatattcctaccgccttttgtaaagttctttttatattgaatatcgaactatatggggtttttcataataagaaaagaagaatagcgccagaaaagcatatgtaaaatatgcttccggcgctattggttacactttcatctgaatcacacggcaaactggctgttatataactgtgcgtaaaatccgttcttggaaatcaggccttcatgagtgccctgctcaatgatgtgtccatcccgcattaccagtatcacgtcagcctctctgatcgtagaaagccggtgtgcaacgataaaactggtccgtccttccatcatttttccaaaggccttctgtatttttatttcagttctggtatcaatggaggaggtggcttcgtcaaggattaacatgggaggaaggcacagcatgactctggcaatgcataaaagctgtttttggccctgtgataaattccctccgtcttctgatatgacagtatcataaccttccggcattcgcctgataaagccgtgggcatgagattcctttgccgccaggatgatctcctcctccgatgcatccggctttccatatgcaatgttgtcacgaatggtcccggatttcagccacgtttcctgcagcaccattccatagctggttcttaagctctgccttgtcatatggcgcacatctgtcccttccacccggatagagccggaattcacatcataaaaacgcatgagaagattgatgacagtgctctttccgcagccggttgggcctacaatggcgatcctctgtcccggcaatacctttaaattcatatcctcgatcagcggaatctccggattataggaaaagtacacattctccagagaaacttctccttttgcgtcagagagcactgcggcgtcagaatcttccgggacctgaggctcctcgtcgatcagctcaaacacccgcgcagcagaggccagtgcgttttgaagctctgtgatcacccctgatatttcattaaacggctttgtatactgattggcatagcttaaaaagctggcaagctgacctacggataaaagtccctttactgctgcaaaagctccggcaattccaacgctggcatatacaagactgtttacaaaacgggtagccgggttgctggtggaggaaaaaaatgtagctttcaagctccagacacgcagattctcattgatattttcaaacgtttcctgggcatcggcttcatgagaaaaagcctgcaccactttctggttccccagcatctcttccaccagagaagtcagttctcctctggtctgggactgcattttgaacatacgataggtccttcttgcaataaagctggcggcaaataaggataccggcgtcaccagcaccaccacaatggtgatagccgggttcatggaaaacatgaaaaacaacgtccccacaatggtcaggaccccggtaaacaactgggtaaagcccattaacaacccgtcggaaaactggtcgatatccgcaatgatcctgtttatcatatccccatgggaatgggagtcaatatattttaaaggaagtatttccaatttatcaaatgcctgggtcctgatatcctttaccacccggtaggtgaccaaattgttgatatggctcataagccactgggccgccgcagtcatggctataatgattccgatttgctttaaaatctcccacatgcctagaaaatcaacggctcccgctcccacaatgaagtcaatggcccgccctgtgaggatgggaacatacaaggtcagaaggaccgtgacaaaagcgcaggccaaagaggcggcaactccccatcgataccggctgatacaaccaaggatccgtttgatggtggatctgtattttttcatgtccatgttattgtacctccttttctgacagctgggataagcagatttcccggtaaacatcacaggaagccaacagctctttatgggttccccagcccgccatctgtccgtcatccagaaccagtatcctgtccgcgtttttgatggtggacgctctctgagacacaaggaacacagtcatatccctggtgttttccttaattgcctttctcagttttgcatcggtagcaaaatccagtgcagaagcgctgtcatccatgatgaggatctgaggttcttttaccaatgccctggcaatggcaagtctctgcttctgtccgcctgaaaggttttttcctcctgcctggattatgagatccagcccctggcccttttcctctacgaaatcctttgcctgggccgttgcaagagcctggtaaatctcctcgtccgtggcagcctttttcccccacttcatattttcccgaagggttcctttaaaaagcactgccttttgaggaacgatccctaccagttcccgaagctgactcaaaggatattgttttacattaactcctcccacctttacggagccttcctcagcatcataaaacctggggatcaagtttaccagggtggtcttgccggagcctgtaccgccaatgatcccaatggtctccccctttttgattttcatggatatgccgcttaaagccgccgcttttgcccctcggtaggtaaaggacatacggtcaaactccaccttaagcgcacccggctcctcttccacggccttgtgagctgtttccacgattcctggttccagttcaaacacagcgcttatgcggccgccgcaggccagggattttgagatggtaatgattaagtttgccagtcttacaagctccactaaaatctgagacatgtaatttaccaaagcgatcacttcaccctgggtgatgatgcccttttggacctgtccggctccggtgtttataagaacaataatccccagattgatcatcacataagtaaggggattcattaatgctgaaatctttcctacaaatacctgaaagcgcaccaaaagtccgttttcctcatcaaaccggcggatctcatcatcctgacgggaaaaggcacggataacacgggccccttcaagattctccctgacagttaaaagcacctggtccaactgtttctgcacctttttatacagagggatgctgacaagcataattccaaatatcacaagggaaaggagggggatgagaaccgcaaaaataacagccgcccttacgttgatggtaaatgccatgatcatggctccgaacaccacaaaaggagaacgaaggaacaaacgcaggaataaattcactcctgcctgaatctggttggcatcgctggtgatcctggtgatcagggttgcggttccaatagaatcgatctcctggtaggacaatctgttaatatgggcaaacagatcattccgcagggaagtgccgaagccgaccgctgcttttgccgcaaaatactgtgccgtaatagaacacaccaggcctatgatgcccagaagcaccagcaatccgcccatcttcagtatataggacatatcatgggacttaattcctacatcaatgacttttgccattacaagaggcaccaataattcaaagcaaacttccagaagcttaaataacggccccatgacgctttcaactttatagtccttcagatatttcaggagctttttcatcctaattcctccgcaataaaaaaatattaatacatttttgatatagtatattgtatcattataccattttggtataatattacaatatataattacgaaatagaggatatccctatgaatctgattaattcaaaacagctttattatttcactgcaattgcagaaacaggcagctttacagctgcagcaaaaaaactgggattgtcccagccgccattaagcaagcagatctttctgctggaagaagaacttggagtaaagctttttgaacggggctccaggaaaacagaactgacggaagcaggcacctttctctattcccgggccagagacatcctgtctatgatggattccattacagaagagctgcaccattttccaactgcttccaaagggattttaaagctgggaaccatctcttcttccggcgctctgctccatgattttttaaaaatatactgttccgcccatccaaaggtgcggttcgagatcacggaaggaaatacttaccagcttctggaaaaaatgaaaaacgggatcgtggaatgtgccattatacggaccccgtttaatggagaaggctttgaatgtgtatacggaaaaagagaaccattgatggcggttggaaatccctcttttttttctggcattccaatgaataaaatcaggctgacagatctttccggcaaacccctgatctattaccgccgttttgattccatcatctcccttgcctttcaaaacagcggcatagagccgaatgttttttgccgcaatgacgatgccaggacctgccttcaatgggcgagcaccggtcttggtattgccctggtgcctgaatccatcagcaaaacggctgagcatacggatctcgtttcccgggaaatcgattctgaggataccgttacaaggatggctgccgtatataagaaaaacggctatgtttcaaacatagccagggaatttgtttcctacttcggaaagctgatgtccctttcctaatcaaaaaggcttaactgggttacatcataattctttttatatgcatgaatgatatccttcatctggtaaataattccgtaccgctggcattcccgggaaaatacctgccacagcttcctggccgccgggcttgtacattcatagctgtttccataccttttgatgtattctgacaccaggtccctttctggaaacagctcccggaggcggtcaaaataccattctctctgattgctgcgtaaagtcacgccaaaagcaggataaatgaagctggctccagcatcatgggcggcctttacgacggaaagaatattttcctcgctatcctccagaaacgggagtaccggcatcaatagtattcctgcaaatatgccgtttgttcttaaggtttcgatcaaagccagccgctctgtgggactggacgcatgaggttcaatttttttcgccaggctgtcatcggtggtggtaacagtcaccttacacagaacaggggaatgctccatgatccctttgagaatatccacatcccgcttaagaagagcgcttttcgtggcaactgctgccccaaagccgtatgcgtcaatcagctccagagcatgccttgttaattcaagcttttgttcaaaggggttgtagggatcgctcatggcccctgttcccacaacgccgtttttcaccttgcgccttaaatcatccctgatgatccgaagagcatcctccttgacccgtacagaatcaaaattccggatccggtaacaatcggaacggctgtcgcaataaatgcagccgtgacagcaccccttataaatattcatgttgtaatcaataccgaaccactgggaaccttttgtcttggtcactatggtttttgcagaaatgtattccatcagctttcgtcctttcctcactgccatactaatacccacaggatccattctaagatttatgacagaatctgtcaatctgccggatccgccaaattataaatggcatgactgaactgtaacgatatttgaaaaggagaatgccttgatattttttttgtcccatgataatatgctaataccagcgaaaaaaaatcgtgacaggaaaaggagatattatgattcgattgctactgcgctgcaaacaaatttatgacaaatacagcaaggatgaaatgaccgtatacgcggctcaggcctcctttttttccatcattgcggcatttccttttatgatgcttttactggcattgatacagcttattccctccatcacaaaagccaatctgcttcagcttatcatcaccatcatcccaagcacactggaaatgaacagtattattgtaactgtcattgacgacctttataccaattctccggtggccgtcctatccgcgaccgcggtggccgccatatggtctgcctccaaggggatgctcagcattgagaggggcttaaaccgggtattcggccaggagaaaaaacggagttatattatgacccggctcatctgtgcagggtataccatcgtctttatggtcatctgtcttctgacacttgtgctgctggtcctgggaagctccattcaaagctttatgaaccgtcattttcccctgcttgcagagatcacccagtacgtccttaccttccgcaccatgcttgtttttatgctgacgatttgctttgccgttctttatacctatgttccggaaaaaaagcaggagtttttaagccagctgccgggagctgccttttccacattaggctggatcgctttttcttttgccttttccatttactttaacaatttcggcaactactccgtcatgtacggaagcctcaccgccattgtgctgctgatgctgtggatttattcctgtatctgcatcctgtttataggcgccgaaatcaattactattattccttaaactggaaggaacatacacgctcttaatcaaaaaccagggctgctgaatatgggcagtcctggtttttctttatttacggatggctttaaactatttaagtaaacaaaggcgtggataagtaacggtcccctgtatcgggaagaatcaccacgatcctctttccggcatattccgggcgctttgcggcttccttcgcagcccacacggccgctgaggaggagattcccaccaaaatgccttctgtctgtgccagttccttccctgtctcatacgcatctccgttttccacaagtacgatctcgtcgtaaatgcctgtattcagtatggaggggataaacccggctccgatcccctgaattccgtgagggcctggcttgcctcctgaaaggaccggagaagcggcgggttccacggcgatcacctttatctcaggattcttactctttaagtattctcctgctcctgtgatggtgcccccggttcccacaccggctataaaaacatcgatctttccatcggtgtcctcccaaatttccggaccggtcatctcataatgggccttggaattagacggattgtcaaactgtcccagaataaaggaaccggctatctctttttgcagctcttccgcctttgcaatggctcctgccatcccttttgcgccttccgtcaatacgatttctgctccataggcttttaacagattacgccgttccacactcatggtttccggcatggtaaggatggcccggtatcccctcatggctgcaatgctggcaatgccgattcccgtattaccggatgtaggttctatgatcgttgcacccggctttaacatgccggaagcctctgcatcctgaatcatatataaggcagcccggtcctttacacttcctgccggattaaaatattccagctttgctatgatggaagctgctgctttatgccgtttctcataattgcacaattccacaaggggcgtacggccaatcagttccgatgcgctttttttgatattttccatattcatcctcttttccactgcaaactattgtaaaacagtttccctttttattccagactagccgggctcttctgctccgattccacaggacagaaccgttcaggctgaactgttatgacagctcatacagcttggtgtatttttcctttatatactgaatgaaataatccggtgtaaaatcctctcccgtaacatcctttaagatctcccggctggttttcagctttccgaatttgtgaacatgttctcttaaatattcacttatcacatcgatcttcccattcataaggagctcgtcaaaatccatctcctttttcatatggtaataaagctgtgctccaaaagcatttcccagggcataagacggaaaatagcccataagtccctgagaccagtggatgtcctgaaggatcccttctgatggattttccgggcgcactccaagatattcctcatatttatccgcccagatctttggaagttcttttaaatccacgtcttcttccatgatcattttttcaatttcatagcggatcaaaatatggagattgtaggtgagttcgtcggcctctgtccggataaagcttggctccaccttattaatggcctccacaaactgttccctggatacattctttaatttttcaggatagagctcctgaagcttctcgtaaagaggaacccagaaagcctggctgcggccgatgatattttcaaaaaagcgtgactgggattcatgcatccccatggatgtcccctgtcccacgggagtctgagtgatctcatcactgatccccagctcataaagtccatgtcctgcctcatgaattacagagaacatggaactgtccaccgtcttcctgtagctggtggtgatccttacatcatgattatgaagattggtagtaaatggatgggcgctttccgcaagcacgcccttagaaaaatcaaagccgacgtattccgcaagatagcgggccatctccctttgcttttcctccggatatccgcctgataagaatgaatcatcaatggtctttccatgctccttgatgtcttttaaaagcggcacgatctcctctttaagacggctgaaaaactcatccaaaagctccatattaaatcctttttcaaactcatccaacagaacgtcgtaaagcttctggccttcctttttcctgtacgaagcgaacttccttttaaaaccgatcaccttctcgagcgtcggcgcaaaagcatcaaaatcttcgtcattttttgcctttgaccagatcctggcagcctcggctatgagctgggcattctcccggtactcctttgacgggatgcagatcagttcttctctggcttcctttgcccctttgacaacggcccgttccacgtcggaaaggcttttatcttcctcacaatcaccaatggctttccccatatcttctccggtcatcaccctgtaatattcctcagaaagcgcaccgatgacccttgaagtataggaaccggcaccctccggcgcaagagtttcattatcccattcaaaaaggaccagggaagtctgtagtgccatggtcttttccagcaaagaggacaaaatttcataagatttgctcataaacagtttctcctttatttctataaaatgagtcggatgcaggaatataagcattcctgcatccggcgaatcctgcaagggaccaatacttcatagcttactgcagggtatttcatttaaaatcccggacgctctgtatgagtgtccccaggcaggatgaaaaaatacttttaaaagcatcattttcccgtaccaaaaatggaagcttcttttatatcaagggttttcagccattttttgactttttcctcctgataagcttccgcagaaaaatccttaagctccatgtcaatgggaatatccgtcttcatggtcgccagggttttggaaagcagagccgccttttcgccgcacaattcctcctcactggtttttgtcagtgccttataaggagaacgggtgatgcccaactggttcttccaaaaatcctgaagttcttttaaactttttttatcagcttcggcttcgcggatggaacggtatatctcttccacagtgccatattcccgaagaagaggcggtgccgcactgcttactccctttactcctggaatattgtcggaaggatctccctggattccttttaaatcagcgatctgttccggcctgactccttcttctctcagcaccgtatcagcagtatattcaaaaaccttttcaggaaggttgacctcttctttttttacgccgtaaaaggaataatattttttatacagctcatctgccttctcctgccgggactggaccatccatgccctcacattgtattcatcgtttattagctggagataatcgtgatcctttgtgagaaggatcatgggaatctcctccctgaatttcatgaccaggcttcctgcataatcgtcggcctcatactgttcacttaaaagcacctgaaagccaacatcctttaaaatgtcctccatcaggataaactggctctttagcggctccggagtaactcccctggttcccttataatccggatacagttctctccgaaaggtatccctggttttatcaaacacaaaggcaatgtggtccggctgctgctttttcatcagggaaactaccatcttaagcattccaaagaccgcattggtataagtgccgtcctttgcatgaagaattttgtcgtaatgcctctgcttttcttcttctgactttgcaaacatgatttcccttggtaaaaccgcatagtaacaggtcgacagcatagaagaaccgtcaacaactacaaattttctttcagacatgtatttctccattccttataaaatctttgcagaatcaggtgaaataattctgcaaatccgtctcatttcttgcgcctaagcgcttcataacctctttccgctcctgagcagataatcccttccaaagcttttggacgcgagggtcaccaaacccaacatagggcaccccattccgctcgcattcataggatgacaagtagtgattgagagcactccattccacataaaaagcattgatgctgcggcttaaagagcttacttttaccatgttccttcctccccgataaattagtcctgtttcatgatacgaactgttccctttacagtaatttcagacatttcttctcattttatccagccataacctgaattccccctccaaacatgtctggtcagatatccaaatttattatactctgaatttccagttattcatagtccattcattaagatttaacatataattttcctcaaaagacgttgaactatgtagcaataggacttataatacaattatccagaatatagaaaaagggaaggtattatcaaaaaatggaaaaagagatcaaatatccgtatattttattcaaaattgccggttccctctattgcattaacagcaaatacatatcaaccattgtacagctgcccaactacagcacaataccggccgccccggccaatgtgaccggaatgttcaaataccggaatgaggtcatacaaatgcttgaccttcggatcacctttggactaaaatccatttccgatgaatgtaaggatttcgaagagatgattgatgccaggaagcaggaccacatcaactgggttaaggaactggagcgctttattgaagaaggcggaaacttccgtctggcaaaggatccccaccagtgtgccctgggaagatggtacgataattttaaaaccgacaatcttaccattgccaaccatctccgtaaaatagaagagcctcatgcaaagctccacatggctgctgatgaagcggaccgatgcaaaaaggactgtgaaaactgcagcagggaagaatgcctgcttaagattttaaagcaggtaaaggaggaatccatgccaaccattctgagccttctggaccagacaaaggaactgttccgttcaaccatatacaaagagatggtcctcatactggacggcatccaatgggggattgtggtggatgagattgttgcagtagaagacctggataccatttcagacagggatgaagatcccatggtaaaccgctgttcctatatcaatcatgtgatggaaagccccaaatgcgaaggccttatctttgagcttaacacaaattacctgtcagccagattaaaaaagctggaagccgctttttaatagaagagccggaaaagttgctgctgaacttttccggctctcctggctaaagcccaggtgctttcctggtctcatttctcagaaatactttttattgccccacaagttgctcttctttaaatccagatattcattgtaggccttttccaatatctgcttttcattggaaaacttcagaagatgatacgcttcatggaatttatagtatcctgaatcaataaaatattcttcccgctgtggtttactgtaatagctgtcggccatcattagataccagtgcacatctttttccaccatatcctgaggcgtgttaaaggagtactggctcttaccaatgtatttgattatggacgcacttacccctgtctcttccttcacctcccggagagccgtctctttgtactcttcacccgcttctactgttccctttggcaaaacccaaccttcatacttatttttgtaattcttatataaaaccagaattttacctcgaaaaataaccacaccgccacaactcgttgcttcaatcattgcaattcctccagagtgaaaccgtaactcccgtcggaagctccggttttggtgtgtcacacagactggctctagtatacctctttttgggctcatatgcaagtgcgtaatcattgaaaacagatatcataatcttctattatctggaaaaatataaatcaaaaagagctctggcaatgggagctgccgtttgcccgccggagccgctttcctccgcaatcacgctgatgactaccttgggatgctctgccggagcgaaacccacaaaccaggcatgggtttccttgcctttttcaaattccgcagagccggtcttcccggctactgtataggcatcggtcctgagagcagagccggttccctcagtcaccacattccgcataaactcagtcaaatcggccgcttccactgcagtcataaggctgccataggactgaggcatgaattttttaatgacatcccccccgcgttttccacgtggtcaatgagatagggcctcataagggttccaccgttggcaatggccgcaacgatcatggcattatgaatgggtgttatctgggtctggccctggccgatggcggtctgaaggatctgccatgtgtccgcaccgcttcccatggtataggagcttttgctgccgccaatgggcaaaggcagatccgtattaaacaaaagctggtccgcagtattctttagtccatttaaatccagctgcaaaccaaggctggaaaaagctccgttacaggaatttgcaaatgcctgctccagattctgatgcccatgggctgtcccgtgataacaccggatggtatattctccattttgataaaccccgctgcagtcaaaggtgtaatccctgtaactggacggattttccctcatatattccagggcagtcaccagcttaaaggtggaccctggaggataaagtccctgggtggcgcggtttaacagctgtcccgaggtgttatcctcagccaccagctgactccagtcagcagccagggtgttgggattgtaatccggcttagacaccatggcaaggatcttgcctgtatccggttccatcacaatcaccgcccctttccgctttcccaaagcgtcataagccgttttctgaagatccacatcaagggtagagaaaacgctgtcgccgggattttttacggttgacaattcatttaccacctgctctatgagatttacatgactggtaagcagatagaaattggacagtgcctccagaccggtcttcccattggtggaatatcccaccacatgggcaaacagggaatcataaggatatacccttgtctcattcccttctccatccacctctgttctggcaaggactctgccgtcattgctgtaaatctccccccgcaccacccggtcggcaaagctgtcaagcctggcgttataggaattgttgatcacattatcgcttcctaccaaaagaaagtagccgaaataaatcccaagccctacaaaaagcagtacgaccccataggtgagcatcaggatatggtgatttgcttttggatttggattagccttcatatttttcttcttcctcttcattgcgtttgagtatatagagtccctggattatcccaaaaatgataaaggtgcttaatatagagcttcccccatagctgaccaggggaagcgtcactcctgtggaaggaatgaactttgtcaccccacctacggtcaaaaatacctgaatgatataaatggttccaagaccaaatgcaatcagcttataaaacaccgcctgcatctggctggcgatcatcatgaactgtaaaaagcagccaaggcagatgagaagaacacacagggcaaagatgcctcccagctcttccgaaacagcggaaaatatgaaatccttttccaccaccggaatctttcttggcattccccggtaaagtcccatgccaaaccagcccccggttccaatggcaaacaaagactgggtgatctggtatccctttcccgcaatatcttcccagggatttatccatgccgacactctggtccttacatggctgaacagttgaaaggccagcatggctgccaatgctccgcctcctgccccggccagaagataccgccattttcccgttgccacaaaaagcatgaatacataggtgataaagaaaatgagggcgcttccaagatccctggaagccaccagaatgagtacatgaagagctgcagctgcggttacaataaggatcgtccgaatgctggcagaccggtaaaacatggtagctataaaaaagacatagctgatctttacaaattccgaaggctggaaggaatagccgccaatctccagggaaagctgggcgccgtagctgctggacccggtaacacatacgattcccagaaggagaagccctacgatcccgtagacccatgggatcctgctcagctgccataccctgtcaatgacaaaggggatcacaaaggttaccagggctgccgaggcaacgataacaaactgcttgatcgaccggtcaaaagaaagtctggtcagcatgataaagcctacggtaagaagcatgcacatattattgaccagcaatctggatgcattgcggtaaatcagcctgtacaaaaacaggtaagtgaaaaaaaacaccacctgggccacgtaaaacaccagcatccgttcatcctttgtctccagccagatgaccagataagccagcagatgaatgagaaacatgtcaaagttctgccgcctgtaaattttctttttcctgatttcatccggaagcgaaaaaaaacggaaattcaaatatgtgtataatgcaatcaacagtatcatcagatatctggagatatcaataatcagattaatcatatgccacctactctacaccgcgtttgaaatgacctctcgtgaactcttcaaagggtaactttgcttctctttcatgaaggaatccgtcagaaaagctttgtatcaccgattttgtctgtgctttattctccgtagtgaactgaagccgcaggttagaaggagataaacccttcacagcctcctggagacccaggagagataccggggccgaattatagatagaattgtagcagaacgcacagtggttttttaccggaaaaatttttcccatacggtcctttaatgtaagaacaaccggagtcctgtcacaccgctccagtccctgatgaagacactgggcagtcaccatcatgggaaggcggccatataccagcagctctcccggaacttttagttttcccaattcccggctgtttaattctaccggccaggtaagctcatccgctcccagcttctttagcattttctgggcataattgttcattccatacatgccaaagtcaaatatcaggcgtcccctgattcccttttcctttaaataaccggtctcctccagagaacggatcaaaaacccgtcaaattcagcagccttaagttccgttaaatatttatcaaaaaactgttttgccagagtccggaagatatgaggcatggtaagcatgcactcctttcctgctctatggcaagattctacagaatccttccacaattccggcttaaattccgcagcatcaatataaattcttttcacatcagagctggatactgccacatcaaggcaatccggcctctccagagaaaccgtaagctccggaccttccaaagccgcttttgggctgtaaccagctttatcacaggcttttaccggtacttcctgcccatcctttctgtaagctctgagaatctcattttccaaagcttccagcccgcgcctgcgtaagtcattaagagcctgaaccggcaagaatacatttccttttatcttaatatcaaggctttcaaaataaaagggcgtatttcccgtcttatccagctgctttctcaccttttcctcagtggcaggctgattctgggcaatctggaccaactccccggtgacagcggcatgatggccgcaggcatttaacaccaaggaagcattcttcccttcttcaaaaagagcggttcccaacacaggctccctcacctgtttttccacaaaattcttatcaagataattcaacagctgctggttgccctcccgaaaagcaggcttttccttccagactaccatatcccgcccattttgccgcttatagtatccctcagtctggccgcccctgtcaaacagatccagaagagccttcttatcctgttcttccacctgatagccttctcttccctgggtcagataaaggtccgtgtatttgcggtaaatgcttaccactccggccgtatatctgggacttttcatccttccttcaattttcagggaatagactccggcctctatcaggtccggaaggatatccagggtgtttaaatccttaaggctgagactatagcggtcatcctttcctccaagagcctgtccttcccgtttcacctcatagggcagacggcaggtctgagcgcatcgccccctgttcccgcttcgtcctccaatgaggctgctgaacaggcactggccggaatagcagtagcacaacgcgccgtgtacaaagctttcaatctccacatccatctgatccctgatattttttatttcctttaaagacaattccctggcagtgaccacccgttctgctcccaggtcctttaaaattttagccccgtaagcgccggtaatggtcatctgcgtgctggcatgaatgggaagtcccggaaaatgttcccgaataaaagcaaaggttcccatatcctgtacaataaccgcatccaggccatgcctgaaatatggaacaagataatcataaagctcctctatctcctgctccttcatcagcgtattaacggttaagtacagcttccgcccatgaagatggatgtaatcaatggcttccagcagcttgtcctcttcaggattttctgcaaaagccctcgctccaaaccggcttccgcccatatagaccgcatcggcacctgccgctaccgctgccttcatactttcaaatgatcctgccggagcaagaacctcaactgcttttttcacatgttcctcctgatttcctatattgatgaaagagaggatgttacggtccagccgcccaacatcccctcctgagttattccttcttaccggaatccgcagatttcctggcttccgccagttccatccttgccgattcaagcttcatctgggtggccacaagctcatgctttaagctataggtctccttttccatttccgccttctgctgctccagtctggcgatctgctctctggctttaaagtaatcatctgccatatttaactggatcatgatattctggtattctgcgctttgcttcgtgaaccctgcctgatgctttaaagtcatgatcatctcattgatgtaactggccaggcgctggatatagctttcttcttcgctaccgcccaatgcataaatcttgccatctatcaaaacttctgtattgcgtttggaatccattctgttctctccctgttatggtttgctcttttttactataacatattttacacagataggaaagccctatggacatacaggtattccaagatgctcatacgcccgttccgttgcaacacgccctctggaggtgcggtttataaatccgttcatcagaagataaggctcataaacatcttccagagtgccggcatcctctcccagggaagcggccagggtatccagccctacgggaccgccggcaaacttctcaatcattgtggtcaggatcgcccggtcattataatccaggccaaacttatccacatccaggatgtcaagggcaaaatccgccacttcctttgtaatgatgccatcgtatttcacctgggcgaaatccctcactctctttaacagtcggttggcaagtctgggggttcctctggaacgtttggcaatttctgcagctccctcttcctcaatttccacctgaaggactttggcagaacggcagacaatgatcttcagctcctgaggcgtgtaaaattccagcttctgcactacgccgaacctgtctcttaaaggggcagtcaaaagccctgccctggtagttgctcccaccaaagtgaatttgggaaggtccagccttatggacctggctgaagaatcctttcccagcatgatatcaatggcaaaatcctccatggccggatacagcacctcttccacctgacggtttaagcggtggatctcatctacaaacagcacatcgccttcctggagattgttcagtatggcagccatttcccccggtttttcgattgcaggccctgaagtaaccttcatattaactcccatttcattggcaatgatccctgaaagagtggtctttcccagaccgggaggcccgtaaaataaaacgtggtccagggattcccctctggccttagcagcatcaatatacacttttaaattggtccgtatcttttcctgcccaatgtactcagccagacacattggccttaagttcggctcaatccttttatcttcttctgttacctctgtggttataattctacgttccatctttgttttacccgttattctatataaatgccaaatgctttaaagacgccttaagcacatcttccactgtcatggactccgtcacttccacctgacggactgcccggcccgcctcggctgcagaatatcccaaagctgccagcgcttccatggcctccccggccactccgccggccaaaacggctccgtttcctggttccgcaaatccgggaggaaggacttcagccatatcaattttatcctttaaatccagaatgatcctttgggcagtctttgctcccacccccggcgccttggaaatagccttggcatctcctgaaacaatggcctttcttaaatcatccggcttaagggcagaaagaacgcctaacgctcccttgggacctatcccgtttacacttataagctgcttaaacatctgcagatcctgacggtttaaaaaaccgtagaggcacatggcatcctctctcacctgaaaatatgtatacagttttgtctcagtaccgattcccggcagcttttctaacactgataagggaacatgtatttcaaatcccatattcccgctttctattacaacggtatcttcaaatatttcaaccaacggcccttttataaaagaaatcacgacctctgtctccttctgactgtaatccaggaaaatcttacctacggcatttatcatagcatactgcctgttgttatgcaagcgcatagtcgaacaaatattctgtttccgttgacggaccggctcctttccgctataatattgagtgttgaggaaggaaataccacacgggtatgcctttatttccaaagacaaagaccgtaataaggaaagggcggtatcattcatgatcactttacagaataccattgcatttcatgaaacatatccctttgaccggatcggaagacgggaagatcttctgttctttgatattgaaaccacaggcttctccggggaatattctaccctttatctcattggatgcgtttactaccggaagggctgctggaacctggtccaatggtttgcagatactctggattcggaaaaagaactgttagaaaccttttttaaattcctaaaggattttacaacaatcatacattttaacggggacggtttcgatatcccctatcttttaaaacgctgtcttgcccacggcatgatttatgatttttccggcgtaaaaagcctggatatttataaaaaaatacgtccctaccgggggcttctcggacttccttccatgaagcaaaaggccattgaggaattcttaaaagtggagcggaaggatctttattccggcggtcagctgatcgaggtttacagggactatcttattacccatgataaatatttatttgatcttttaatattacataatgaagatgatttaaaaggaatgcccctgattcttcctatattaaattatccggactttctggagcatggcttctccctggaacaccaggagctggtatgccgggaggacatctttggccgggagttccactccgtacggcttacctgcaaaaatggttttgccgttcccgttggattctcaaaatccaattccctggtattcctggaagcagaaggggaatgcctgaccgtaaccgttgatctttatgaaggggaattaaaatatttttatccggactataaaaattactattatctgatctatgaagataaggccattcacaaaagcgtagcggaatacgtggataaggaagcccggatcaaggccacggccaagacctgctacacccgcagggacggctgctacctcccccagttttcgcccctgtggactccctgcctccaaatggatttcaaagataaaatcacatatgtttcctatgaaccggatttctttgaagatgaagaaaagctttgcctttatatccgtcatctgctggataccatgtgccggtaatgactgaagcatttcccgcaatttccggaatgccttaggggaggtctttacttttttcagtctccccaaggaaagcttcacctttaaattcactttttctcttccggataatccccttttttcaacaaatacctgatgtaagaaaatgtctttttttctccctggtttttcagcatgagaagaagtctttccaacaattttctcgtttccggggcaatgaccatgtagttttttgcgtgcatataatattcccagggtgatgcatcggtgtaatcctttcccttataggttttcgatgcggcgatccggtccatcatcatctcaatgacataatttaatggcatcttatggcctaccagtccctccgacatgtccgtggtaaaatcgatccagtattcataatgatgcttgttgcggcccttgtgatggagccaggcccttgaatagcccttgtcctctctttccgcagcgttgggacttctggtcccctgataataaagaacaccaggtatgaattcttccggactgtattttgataaatcgtgaagcagtccctgctttataaggcccactcgaaaacagtttttcatgaccctggctttgtgtatattaatggtgcaaaaatgcccccagaaattcataaacttcatttctttccccttctcatccttacaaaagaatcttttcccattttaccacaaatttctctggttttaccactcattttcccttaaatttgccatagagatttctttctttttaaagcggaaaatgtttgacacctttccctttttatgctattcttagggaggttacagatatcctgtaacagtacaatttttttattcattttggaggtatcatcaatgaaaggtacagttaagtggtttaataaccaaaagggttacggatttatttccgacgaacagggtaacgatgtatttgttcactactcaggtcttaatatggacggcttcaagtccttagatgaaggcgctgctgtagagttcgatgtggtagacggagctaagggaccacaggctacaaacgttatcaaaatataatcattgactcatcagtgtacctttttcaatatataggaagaagttatattgtttcacatgattacgattagagccatccggttggatggctctttttgacggagtttaatatggttttcttatgatctttcatgaagtctttttaaatcttccaccgtaaaatcataatttttattgcagaaatggcagttcacttcaatggtatttccttcgtcgatcatttcctgaagttcctttttccctatgctgaccaaagctttttccaccctggccttatcgcagttgcagtaaaaacgggtgggtacctgctccatcatttccagaccaaactctcccagaatgtgctcaaggatcatttccggtgtatttccctgatccagaagctctgtaatggaggtaatctctcccagctttttctccaggctttcaatgaccgtttcagacgcccccggcaatagctggataataaagccgccggcctgtttcactgtgttgtccttattcattaaaacacccagtgccactgatgacggtgtctgctccgaagcggcataataataagttaagtcttctgcaatctctccgcctaccaatatggtctgtcccacataaggctctttcatgccaatatccttaataacgcttaagactccctctcctaccgcacctcctacgtccagctttcctgcaggactgggaggaagcatgacgccgggattgtaaacatagccttttacatctccctttgaatcagcagtcaccgtaaggccttcaatagggccgcttccctgaatctttatggtcagtaaatcatcttccccttcatcatgatacccatcatgcttcctgcagtcagcaatctgcctaaagcagccgtagctacagggcttgtattatgagcctgtcttgcatgctccaccagttctctggtagtagccgcaaaggcacggatctgatgatctcctgccgtggctctgacaatataatcagtcatcttatcattcctttccgcattctcttgctatgatatagattctctcactgttttcctttacgggagcttttgtaaaagcatcaaaagcggctacaaaatccatgcctgcttctttcattgccatttttacctcatcaagagaatacgctctctggaaatgattttccgtatatttccggtatacatcttcctcctgcctgatgaacagggcgagattgtattcattgatcccggattccttatcataataattatcccagataaagctgcattcctcccggtcctccgcaatggtggaatctcccataagagtttcatatttataaattgtgttcagatcgaatataaaaattcctcccggatccagataattatttaccagccggaaaacttccgtcatatcctcaaattccaggatgtagttcatacaatcacagatgcttataacggcccgtaccgttccgtaaagttcaaattctctcatatcctgcataagataaaggatgtctttttctgacttttcccgcttttccatggctatctgcagcatatctccggagctgtccaccccgatcatgtcatatccccggtccgcaagaagctccgtaaggcttccagttccgcagcccaagtcaagaatcagcccatctctgatcccatattcattcagcagaccggtcacgtattcacaccagtccctatatgggatattgtccataaaccggtcatagacctcagcaaagctagtgtacgcttccattcacaatttcctctttcctgccatgtactttgggcataaaggtatgcccgaagggtgtttcctctttcctgcccatgtactttgggcataaaggtatgcccgaagggtgttttacgccctaaaaacaaagcaggtaactcataaagaggtacctgcctttctgtctctttatcctgccgccaaagcaacgtttgattacaggttggatccgcagcactttttatacttcttgccgctgccacatggacatggatcgtttcttccgacctttgcacctttcacaatggttccggaagctttctgctttttgtagagttcttttttcttctcttccgtcagtatttcatcccactgaggaaggctgtacagccactctgccttagcttctaccatattataatacagcttttccgggtcgatctctatttttaccacagtctgttcatccatggtttcaataggattttcatatccctttaagctttcattgattccatctaaaaatccggtcatcgtctggacatcggttccatatctctttgccagttcttcgaccgttccctcaactgcttcttctggtttggaaagaatatgctcatagattcctttttctactttgaaatactcggtccataattcttcttttcctttatcatccagcccatcgccgtatgccagatttctccaattttctaaaatagccatgttcaaaccatccttttgtctgttattctcgtgaaagtaacgagccaaagtcaatctatcttgaccttagcgactgcccacgcagtcaaattccccatcgcctgctgcagggtaattgacttctgatagtactccaacaaacagtatataacatctttatctattttgcaaaatgttttttctgattttgtaattctccgcagtcaaatcacaggaaaggcaactcaccggttctctccaggggcctttgccgccttacagccggttcctgcttatgcccagaagttttatcatcagatccacgcttcccacattgtagccgctgcagccgtaaattgcccttaaaccagggtccgtaacgatcaaaagcggcagtttttccggatccacatacattttccgggccaggggctccaccgtatcatcaaagcttatgtaccctgccttgattcctggtattgcttccaaaaccctatttacggtgcggttctttaatgccgtttctccttgcagcaggaaaatgatcctggcatccagagaatttaaagcgtctttttgctccagcatttcgttaagaacgtgctctgtaggctcctgtccctctgacagaatggccagaatattggctcttccctccatgagtaccgatgccggaactgtctcctctattccgctttcatctgtcatagtcacgtcaaaatcatccaacatgttgtcgaccagcatatcatcaaggcttccggcccttaagcgcatattcacagtcttttcttcatcctttgacagctcaaagacatactcgctggcgttctggtttccgtttggaaggcggacagaggtgatcaaacggtaaattccaggctctaattccagttttaaaacgccgtcggaaaacttcacgccagtgtaatccagggttataaactgtccctctttcagccttccgatggtccatgtctggtaataggtccacaggctgtcactttccccgtaaagtaccagctttcctgactcttcagtcctgttttctattatctcctcagctcctgatattgatacaaattttccagcctcataaacttccgcctctaaattcaccggattcatacgggatggaatacccaaagtccggcagatggcaacaaacagtatcttcttgctaaggggattgctctgtaaaagcctaagacttcctacaggtgtggaacaaatcgtcttgtaatccagtttttgttcaaaaccaatatgctgtttcacgtattcccaaatagttccagggtttttcctgaacccgtccttttctttctcattaaaggagccatcaataaagccccggtaatccgtcatttcttccagcagaatccttggacagagaatatattttacataaatatccggatttccattctcctcccacttcttacggtaaggagctgcccatgccagatggttttccaggatatccgcccttacatccttataatcctttgccgtcaggctgtgaagcattgccttacggtccggattccggtccttggaaagaaatttataaatctcgtcaaagttaccggcagataaccgcaggatctctgtttcctccggatattcggaagcttcttcctctttaaagtatcctgcaatcctgctttcccgcatctggtttgcctcttgaatccgctttctgtttctctccttttgttccctggtaagcgtcaccggattcatggggtaatcctttggagctttgacgtctgcatctgtccagacatccgttccggatctcccctttctttctgtaacaccagcacacttccattccggtcttccggggaaatccacgcttcacaaaacaatccatccttcattgcacggacatgaacatctccaagtcccatggtaatggaaacttttccatttctgcctgtatataagtttaccacactgcagtattccgccatgttgagaatttcaaaagagacatgaacattttctattggtttcctatcctcatcaagcacctggatttcataagacctggtcagggcgtaggttggagttccgttataataaaccaataaatcatcctgccccagacattctgtttctgaatcgccggaataatcggaaaaggttctggtgtgcaccagaagtgctctggaggaagcattggtaaaccaccccttatccagcacttcttccggctcgcaggctccaagaaagtgccactttccttctacaaaaacttcgacccatgcatgattatcatcacaatgggcccatctgggcgtatacacctgtctggcagggatccccacgctccggaaagccgttacagcaaaagtggattcctctccgcatctgccctttccggatttataaacagttataggagatatggtcctgttgtcggaagcctcataggttccgttttctgcacaccagtaattgatttccagaactgcttccctgacggaaagccctctgatccggtcaatcagcctgtcatagaaaaacctgcggcagtcttcaatgttttccgtattgatcctgtaatataaaatatgatggaggaaaatatcttccggaatctcctgacaccattccatttgttcataaaccatgatggaatgccttacaaatccaagaaacaggtcaaaatcgtactctccggcatcccgtaccggcatggttccatataaaaacttcatgagcacctgttcccttggagtacagcattccatagctttctcgacttcttccctaagacctgccagaaagggaagtcttaggtcatacttttcctgggcatatctttgcaaatgttctgaaaacatcacaaaactctccttttcgaaatcaattgattattttcttcctcagctgctccggcaaaggctacagaatagtaactcccgcagagtaaagcttactggccgtagcctcatcaggcatggaatccgtgatgatcccgtcaatatcatcaaaatgagcaaatttataggaatcattaaaatagaatttatccttttccattaccagatatttatgcctgctgctggcaatggccgctctctttgtcaagccatcctccacacctaaggtggtgatggaattatccgtaagatccaggccgcaggtcccgacaaaggcccggtcaaagctgtactgcttgatgatctcaatagcagctgcccccataaagccgtttaccgtgcggtacatgatccctccggtgcctatggctgtgatattgggatttacagccagggtctgcataatgtcgatcatattggtcaccacggtcagccgcttgtgggatttggcaagcagttcggccaccataatatttgtggtagaaatatccagaaatatggtttcattgctcccaataaggtcaaacgccttctgggcaatcaatttctttttctcaatattcgtatccctccggtcaattacatcccgtttcaagggataatcctgggataataaggctccgccataggtccgtttcagctttccggcattttccagattttttaaatcctttcgtatgcagtcctctgttacctggaaaagggcacttaaatcctttaccttcaccataccctgatcctgtaggatctgtaaaatcctgtctaaacgttcttccgtaaacatgccttttcctccatcagcttctttgcccggcgtatctgttcctcctcggtacgaaaaatatcatactccccaatccccggtatgcccatatttacatgttctttccggtaggtcatgccgctgtccacaatcgttttgcctgacatgtgaaagcaccgggcgcctatctcatccatcaggctggcaatggcctccacattgaccccgcttccagccatgatgtcgatcctgccgtctgcctgcccgatcagcgcccctaaaagctcttttccttccatacaggtattctgctgcccggaggtcaggatcgtatccacacccgcttccatagcctctcttaagcttctgtaaggatccctgcatacatcaaaggccctgtgcagggtcatgcttcccgcacctgtcttttcttttaaaaccttcagccgttccatgtcaagatccccatccggctttaaaaaacccacaacaattccatctgcaccaaggtcccgaaacatctgcgcatcctctgagatcatctgaaattcatgatccgtatataaaaaatctccataacggggccgaatcagcacattgatgggaatatcacaggctttgcgaatctgcttaaactggcttacaccgggagtcgtccccccgatcaccagatttgtgcacagctccagcctgtctgctcctccccgtaccgccgccttggcagattctacagaatccacacagacctccaagatatagtccttcatcgttttctcctaacaatctattttttattgcctgcatactgcgttgctttatggcaagcagcaaaatgtcctggccttacttctttcatatccggtgttttttcccggcacagctcttctgcataaggacagcgggaagcaaaacggcagccgtccttcaaattaacaggatttggcagactcccttccagcatgatccggctgcggctcttttccacatcaggatcagggatgggaattgcggaaagcaatgcctgggtatagggatggaccggatcttcaaagagggtttcactgtccgtcagctccaccattgcccccagatacatgactccaatccggtcactgatgtgcttaaccatggaaaggtcatgggcgataaacagataagtaagtcctctcttttcctgcagctctttcagcaagttaatcacctgcgcctgaatggaaacatccagggcagaaatgggttcatcacagatcacaaactccggatcaacagccaatgccctggcaatgcccacgcgctgacgctgtcctccggaaaattcgtgagggaaccggtttgcatgctcttcagaaagccctactgtttccagaagctccatcactttctttctccgctcctgcccgcttaagattccatgagcatcaattccttccccaacaatatctatgaccttcatcctgggatttaaggatgcatagggatcctgaaaaatcatctgcacttttctggtaaatccatgacggtctgccgccggtaaactgctgtcaattttccttccatcatacaggacgctgccttccgttggctcatacagctggatcacagtcctgccgaaggttgactttccgcagccgctctctcctaccaggccaagggtctctcctttataaatctccaggctgacatcatccaccgcttttagaatctgattttttcccacatggaaatatttcttcaagtgctttacttctaataatggtctcttttctgccgacataatgatttcctcctattccctgagagcctttgcccgctcatcaagaagccagcagcgggcgtgatgcccctcgccgcaggccatatcctccggcggatactgtctgcagacctccatggtctttgtgcatctggctgcaaaggggcagcccttgggcggatccatcagatccggcggcgttcccggaatggccgtcagctcatttcctttatgggaagcctttggtatggaagccaaaagcccttttgtatagggatggctggtctggtaaaacaactcacgcacaccggcgttctccaccagctggcctccgtacataactgcgacccggtccgcaatattggccacaacccccagattatgagtgataataataatggaggtcttgattttcttctgcagatccttcatcagatccaggatctgagcctgtatggtcacatccaaggccgttgtcggctcatctgcaattaaaatcttgggatcacaggccaaagccactgcgatcacgactctctgcctcatgcctccggaaagctggtgaggatactggctgaacctggcctccggattggatattccaaccaaagagatcagctcaagagcccgctccttcatctgcgcttttgtcatatccttccgatgctcttttaatatttccacgatctgctttccaatggtcattgttgggtttaaagaagtcattggatcctggaatatcatggaaatatctgatccccgcaccgtctgcatctgacgttcactgtattttgcaaggtctttgccttccaataaaatggtgccgcctacgatttttccattcttcggaagcagtcccataatgctttttacggaaatggatttaccggagccggactctcccacgattgccagagtttcctgctcatccagataaaagcttatcccccgtaccgcctggaccacgccatgctgtgtctttatatgtacctgtaactgattgacttctaataatctgttcaccacgcttcacctactttctcattcttggatcaagagcatcccgaaggccgtctccaagaatgctgaagcacaccatgatcaagacgatcacaatggccgggaagatcagtacatgaggaaaattacgaagcacctggtatccgttgttgatcaaaacacctaaagatgctttcggctcctgcatgccaattccgataaagcttaaaaatgcctccgtaaatatggctgagggaatggtaaacatggcattaatgacaatgaccccaaccgtatttggtatcagatgtttccagatgatcccggaagtactggtccccagcacccgggccgccagaacaaattcctggtttttaagctttaaaatggatccccggacaaggcgggccatattcacccagccggtaatggaaagggccacgacaatcgtccagataccggccggcatgaccatcatcaaaaggatcacgatgatcagatgaggaatgcccaccagcacttcaatgatccgctgcataacagcatccaccctcccgccggtcaaagcggaaaccgctccataagccactcccaccgtcagatccagaagagccgccacaaatgcaatgagaagggatatacgtgttcccatccacgttctgacccagaggtcacgtccgaactggtctgttccaaacaaatgcgccatggaaggagtctggtaaatgatatcataattggtttccttataggaatatccagaaaactccggtgccagcactgccagaagcccgattgcgatcaaagcaaacaaacagacgacagccgccttattctttttcaaacgaagccagccatcctggagggctgttaaattggggcgggcaatatgttctttctccgattcatccacatatgcctttacaaataattcatccatgcttaaccctccttaccggctgccagacggatcctgggatcaatgaaggaataagcgatatcaacgatcagcaccacaaaaatatagaaggcgctgtaaaaaatcgtgattcccatgatcgtggaatagtcattagccttaatactgtctacaaataaactgccgattcccggaatggtataaatattttcaactgccagagatcctgtcagcagatttaccacaatgggacccagaatggtaaccaccgggatgatggagtttcttaccgcatggcgcatgagcaccttcatcggactaagcccttttgctttggcggtgacgatataatcctgctccagcacttccagcatctctgtcctgataaaccgggccaccatggccgtggcggaaaaggacagggcaatggacggcagaaccgaacatttccagtcggtccagaaaccaacgggcaaaattccccactttaaggccacatagtactgcaaaagagccgcagccacaaaattaggcacagagactcccagcacggccacgatcatggtaaaataatcgattccgctgttatgcctccacgccgcaataattcccaatgtaaggcccacagccagtccgattaacactgcctggaggccgataagagcagagggaccgatccttcccccgattacggtagaaaccttttgtccggtataggtaaaagatgttccgaaatccccgtgcagaatatttcccatatactttacatactgccgggggagggactcattcagtccatactgctttaaaatggtctgctgctgctgaacggacatcagattaaagcgttccgcatcaaaaggagagccaggcagcttcttcatcagaaaaaaagtcgctgtcacaatgacccataatgtcagcgccagataaaccagtcgcttgcagatatattttatcatgctgtgtcctcctttgcattcatattctcatgagattttaaaaagagccgcccttttccaattttgaaaaggaaggacggctcttctcattttccgcattccgttagtcagggcgaacccctgtccgccgcggcttactcaaaataagcatatttaaattccacatccggtccgaaaggatggctgatcaagcctttcacattggactttgtaagggttgctgaacctctgtgatacaaaggagcaacgatcatatcttcgtcaaccagaagcttctccgcctgcagcagcatatcaagacgcttggcgtcatccgtttcgactctcgcgtcatcaatcagcttattatatttttcattcacataggaaccgcggtaaggagttccgttggtccacaaatcaaggtaggtcatggcatcgtcataatcagctccccaggcggtggatgcaaacatgtaattatcattatccattaattcgtttcttgcctgaaccgtcttggtatcgatcacaagatcaatgcccaaattcttactcaattcactctgtatgtaggttgcaaccgcttttgttacagaatcatctctcaccagcaaagtcagagcaggagtctgtcccaattccttgcagccttcttcccagtatttctttgcctcttccggattaaatggacatatatttccatttaactcgcggaagcttttgctttcgtttccatacatgccttccgcaaccagaccgacgctgggggcagaaccatctgacagaattgccttaaccaaagtctcgcggtcaatggccatggaaacagccctgcggatatttttgttggccataaccggattacttaaagaaaactgcagatattcggttctgaactcgcttttagaactgaattccggatcattctggtaagcggccacattggaagaatcaaggtttacctggctcagctcatttgccagataagcgttaagagctgaggaagcgtccttcataactcttacctgtgcattctcaatctttacatttgccgcatcccagtacttttcattcttctttaaggtagcccctactgccggatcatagctggtaataacgtaaggaccgcagtaaatcatattttccgcacttaacccatactgatcgccctttgaggtaacatattcctcatttaacgggaagaactggcaaagaactgttaaacgggcaaaataaggagtaggcgcttttaaggtcacctggaaagtcttgtcgtcaagggcctttactcccacttcttccgctttgactttgctttcgttatactcggcaccgtttacaatataatccgtcataatgaagctgtaaccattggtggcctccgcactcatctgctttaaccaggagaacacaaaatcctttgctgtcaatggagttccgtcgctccattgcaggccgtctcttaaatgaaaggtgtatgtaagcttatcatcggaaatatcatagctttccgccagggcaggctgtgcctcatgattctcatccaggcgaagcaggccttcaaatgcattattgtttaccttggaagactggttatcggaagctgcccactgtaccagagtcttgatctcagcattggcgtatacgctgagcacctgaccgcctgctgccggagcagcctctttgtcagaaacagattcgcttggagccgtactctgagaagatcctccggtcgtaggactgccggttgaaccggtaaaaccacatcctgccagggatccaataacaagacaggccgccgcacctaaagctaatactctttttttcatttcttcctctccttttaatattgtttttcttgtttcgtcttaatttatcggcatttcgcccatgaaattatttgaattatacataattatattatttatgtcaatattttttatcatttcatcctgttttgaattgttttaatttcatatgaaaattcctgataagacgaatcacggcaggggctgttaccttaagcccctgccgtttccaatattgccggtgaaattcatgtccaaagagccattcagcaaagacttcctgaatacaaagaattacagcccttcctggaaaaatccaggaacgatacacaataagaagaatcttcctcttctgctctcatcgcccggttgtagatatccaacgccttttctactgtgatctcaatgtcatggtaatagtataaggtcgcttgcgtatatgaaactacacgttctatcaacagccttgcatcctggttttcaaacaatatttcatttaagttatttcttgtgatcatcatacgcgagtctcctttcgcatcagaacaaacgttcgtttaatagttaaaaattaaaaccacgtcacagtggttctaattaaaatttcttgttcctggctggaacgtcttagtgtattcgtccacttgcctatttacattataacacaaacaatccgcaaatgcaaacatatgttctgtttaattttaaaaatctgcctgaatttttcaacctgcaagccacttgccgtcttcccgccccggcccatggcacaaaaaatgagagaagccatataaacaccggtttatgggacttctctcattaaaaaggggaggataagtattcactcatctttggtataatcctattatgacctgatccagatgttttattcacataaaacaaagattattttatcttattctgtttccccataatgtttttttaatttatcgtttaagccttttaaatagatccggtttagggaaagcattgcttccgatttttttaacggctccttttttatcttttcttccaggtcatttatctcctccctgcatctgcaaatctgatccttcagcatggaacggctgggcattttcatcagggcgggcaaatcaagagtccttatgaggaaacgcgtcaccgcgttctctgccttttcctcatcttcatagatcctgttaaaaaaatcacagacagcatgataaaaatcatcgtgctgcctggagtcctctccggctttgccgcaaaccatcagacttccatctcctacgaggaaacagactgcagccggttcctctttatccaggctgaattgacttttttcaattccatcctgttccagtccctcatgaatcatatcaaaaatataccatttgaatccgctgatttcagacgctttttcaagcgcttccaaaccgttggttttcctatcttccattccttctcctctttcctgtatcctgttattttgtgcctttcctgaaagccggatcatgccggcgaaccaaaacgtttttaaattcagtgcaggcttaacgccagtatttttattatatctgatgtcctcaataacctcaatcataaaataaaaacgagctgcggtatgtcctgtttttaacagaataaggaagatacacagatcttttgtcccctttaaatattcgtaagcctttcaaacagactgttgatttcgatctggccatatccccagatattgttgggataagtattactgctgctgcgctccgctccccgtatgagcaggcggttcacatcgtttccggtaatattggtataatttcctctgggaattgcccattcaaagaccatggcaacaacacctgctgcctgggctgctgcagatccgcttcccgttatgcttccatactggtttcccggtaccgcacaggtaagctcaaatcccggcgctgaaatatccggtttaataaatccggtccttgtataacctctcccggattcaggcaatgtggtattattaaattgattgtaagcggtaactgtcaggggattggttgcatttcccggggaagttatggttgtgtccggattggaatttataaaaaaggtctcctctgaaattaagtctcctgaaggcagccatgcgtgaaaagcgaatggtccattatccagattctgcacacgaatcgtccagattccgggaaggggatcttgaaaacgcatcaatatcagctggtccccggtctcttcttcaaaaatataattattgacccacacaatgccctgattgaatacaaatgaaaatcttctgcactcccccagtgccggaaaaacctgccccgttgtctccctgtttggagccgttatttctatagacagtcttgcaggtgcaaagggccatagctcaatggcaaacagtttgtcattttccccgactctcatctcaaagtcattgaggaagggctccgcagctgtgctgttaaaataatgtctgcgcttgtttgcttcattgccggtgctgattgttatccctgtctgaggctgttgtgccagataattggtaataaagctggtggccccccgcccgtcatggcttgactggtttgttcccattgcaatgcatatggcaatggggcggttcagtctttgggcgaccgaagtcacatagctgatcccaatgatcagatcggactcctgatagcattcaatatcttcagaaacaaaaaagatcctttttaagctgttctttgccggctttagtttcaccaccagcaaatcggattccggtacaacaccgctgaaggactgctccagactgggcttccctgcaattacacttgcaattgcggtcccgtggccattggtatccaccgaagggattatggacaggggattttccgaccttaacgccacatttatatgctccctggtgtattccgtaccatatgtaaagccctccggcggatcgccatcctgtatggtctgatcccacagggaaaggatgcgggtcgttccgtcattatataaaaacgcctgatgctggtaatcaattcccgtatcaatgaccgccacaataactccacgcccgaataaggccagataaggatttctttgaaccgttccgataccggatttttcaaggctgacagtggaactgagggtaagtatggaaggaaatgcattgtatggataaactcccaagtcacagggattcactgaatcattaggaatatgagccaaagaatgccttaaattcaaatgtgttatattatctccggtatcatatgttggaatcataacgttactaataatcaggtcataatagctatcatccaatattttttgcatggtcaggcctccctgtctatactactggcacatatgatatattttatgcaatttaattcctattatgagcataagaaaaaaatcgcacatatgttctcattcatcacaagcagctttagtcatataaatggaaatgagcggacaaatgtatgggaacaacgctcatatcaggaatattgccgcataaaatgtatcatacgttttaactagatcttatcagggagacttaattatggaaaaaatactggacaataattattatgatatgattatcagtaatttagtggttccaaccgttggagtcggtaatgatatcacagtcctcaatgacaggttttctctgctgcatatatccaaacacaacatgcagccgtgtgatctcggacaaaatccttatcatattttcccctccctttatacccccacttctgaattcggtccccaaatacccgatatggaaagcaccatggcaaatggagaatacagcttatgggggcagggagtaattatcggcatcatagacactggcattgattaccggcatcctgcatttatgaataatgataaaacaagccggatcatttccatatgggatcagaccatacaggatggaacgcctccacggggatttacctatggtacggaatatacaaaatctgccataaatgatgcgctccattatgaagatcctcttaccgttgttcctacaactgataccatcggccatggtacagccatagcaagcattgccgcaggcactcccagcagggaaccggcttttagcggcattgttccaagcgcggaacttgccgtcgtgaaactaaaagaagccaaggcaaatcttaagatgatattttctgttccggaagacaaactatgcttccaggaatctgacattgtacttggaatccgctatttgaccggcataagccagcggctgaagcgtccgattgtcatatgcattgctttgggcagcagccagggcagccatgacggaaggggagttttaagcacctatttggaaagcctggttcagcagccggacctgggcgtttccatatctgccgggaacgaaggaaacagcagcaggcattattttaaccagacactttccacgccctattttaatgacttccagctgaatatagcaggagttgacagacagttttccatggagctctgggtccacattcccggaagggtttctattgaaatttccgcaccaaaccgggaaatgatcccatttgtcagtccctcctttgatgaatgccaaaagtttgttttccagcacagccaaagcattgtctgggtaaacaacatggcctttgaaagagaaagcggtgatcagctgattttactgcggtttgagaatcccctgcccggaacctggtacttccgcgtacaaagcacggaaaatgaacccttttcatatgattcctggctgcctagcggtgacttgatatcaaatgggacctttttcttaaatcccaatccggatacaaccataacctctcccggcaattccaggcgcactctcactgtcaccgcctataaccagcagacatccaatattctggacgaatcaggaaggggttacacaagaagcggcctggttaaaccggatattgcagctcccggttatcagatcccctgtgcaattccggaaaaccaatacggtaccttaaccggcaccggcgcttctgcagccattgcagccggcgctgcggccatcatttttgagtggacccagggcaaaggaaatttaacctatatctcaggggaacaggtcacccgtatgctaattagaggggcgcagagaaatgctgcctatcattaccccaacaatatatggggatttggacaattggatgtataccgactgttgcagcgggtatccatgctcttataacttacaggttcagcttgtcaagcctgaccttccttaaacaaaagaaaccaacagataaacgttggtttctttcagaaaacactttttcttttcctttaatcctgctgcactgcttcctgctgggttcccagctggcttgtacagttggggcagcgggtggcatttatattgacccgcgtgtagcaaaatgggcactccttgtccacaggagcagccggctctgcctgctgcttctttccccgcagagaattaatcacctttatcatgaagaagataaccacagccatgataaaaaagttgataacggcagtaataaaggaaccataagcaaacaccggtccaagagcctgtgcagcctggagggtcgaaacatccgcaccatcaggagcgctgtacagaagcgcgaatttattggagaagtccactccaccggtaattactccaatcagaggagatatgatgtccttgaccagggaattgacaattgcctgaaaggcggcaccgataataacgcccactgccagatccaccacatttccgcgcaaaacaaattctttaaactcagccataataccttttttatttcccataagcattgtttcctctcttgcagctttataaaatttactggtaaactttggaatcataatatcataaaacaaatgatcctgcaattcgtgaatttaaaaacacattgacagtaacctttttcctgcagccgtccattgcagaaataccatcaaaatatggaagaatcttttaaaagagcgggtacccaatatcggatacccgctcttcctgttaacagccgcacttatcttttgttgcctctgcagcaaggatcattgcatccatctctgaaacctgcacaataagcctctctctttgcttctgcacaaggatcgctgctgcagctgctacggcatctattgttacagttattattacagttgttgcaattattattgcacttacaaccacaagacctagaattaaaacatcccatatcatatacctcttcacatagttatattttattgtatgggatgaccagacaagatgtgaattacataaataaacattgttttgtcgaaattccgtcataaaataatttcttttttaatattgtattccggatactgacccggttttttcaattgtaatttcccaataatattgattttacggcattttcaatttcttcataaccggtgcatctgcataggttggattgcagccattcctctatgataggatcatcggcgtttggaacgtgcttggccaaggcatggcagaccatgagaaaccctgatgtacaataaccgcattgaaatccccagtttcttataaatgcatcctgtatgggagcattgctcagaccctctattgtggttattttatgacccaccgcctctgctgccagcatcaggcaggatttgacgggcatatcgtcaaccagcaccgtgcaagcaccacaatccccgttctcacagccgctttttgccccggttaaagataactcttcccgaagaacatgaagcagagtgtgggccggcttgaccatcacggatttttcttccccatttacattaagaactatcacactgtttcctgataaatacatacaaatcctcaattcctgaaaacatcatccgatcttttcaaaattttcaaacatttcctgcagcatgttttttaatacaaattctctatactccctgcttcctgataaatcgcccttacaatcattgtgggctaaatgaatgatctttttaatcttctgttccgtgttatataatttatggtttatgatcctttcggacaagatgataggattatccccatatccggaaatcgccgcctttactgcttttttatctttcaaagccgtcatggtaatcagcgggtaatctattttctctattttggttcttttcacatgattgtatggcaaattcaaattgtcctcttctatggatatggataccagaaattcacctttttttaactgcaattttcccttaaatgcctgtaaaaacggcagctggaccaccccgccctgggtcattacctggagggaacacttactgagcataagcggcaaagccgattcccgatacttgattgttccggccagatttccgccaatggtgattttcccctggatcgtgtggtctgcaattcgttttatggtttcggacagcaggggaaatgcattgtattccgcaatattcgtaagggtttgtgccgccccgatttttaatttcccgccgctgacctcaagctggctgcattcaggtattccttttagatcaatgactgcatcaaattgtatgctattcaccctggccatggagatgatttccgtgccgcctccataataaagaggttttttgttatttaacagcaaatcaccatagcagccgaatgcctcttccatgctttccggtttataataatcaaaatcaaaaggtatcataatttagacctttccctccatatgaattcaggcgtaatgggaagacggtttacatctatctcagctgccaatgatacggcgttagccagtgcggcaggtattccaataataccgtgctctgcaatgcccctggcgccgtaaggcgcatcaatttggggtgtctctacaaaatcgaccagatattccgggttctccccgtaacggatcattttataggtgcggaaacttgtatcttctacaattccattttcattgtaaatgaaatcttcgctggtacctaatcccaatcccatgcacatgccgcccattatcaccccccttgcagttttggggttaataaccttacccgcgtcgattacggtagccgcttttaaaagccggtaggtatgctgcctggtatcatattcaatttcaacggcctgggcgccgacggtccagctctggccgggcactccctttccagaggcctcatttaatggtgtaagatgattcatgacatagctgccccgtccgataacaggccctttgacggcattgccattggaatacatataacccttgaccagatctttgaacatgatataaagcccgggatcatgttttgcataaatcattttattctcaaaatccagatcctcaggcggacaacgcagggcaattgatgccaagctcagcagctgggataaggcatcgtcagctgcattcaacacggcacgccccactaaaagggtagtcatgctggcgactgttttccataaatacggtgttgactgggtatttacatccagctttacataaacgtcattgatgctcattttcattttttccgccagcagctgcgctgccgttgtcttcatcccaggaccgatttcagcggcgccgcaatccaggttaatgctcccatcagaattaaaggtcaagacagcgcttgcgcctgcatccgtaggagtatcggaggtcttgatcagacagctgatcccttttgccctgaccaaaccactcccttcctctatacgcgccccttccttccagttaatgatggttttcagtctctcaaggcattctgcaggattgcctgtattactggcagtgatcttgacctgggtcggagttaaattaccggcatggaccaggtttaaaagccttaattgaaaaggatccagccctgcctcggccgccagcttatccatcattctttccagacaaaaggtatgagcctcatgtccgaacccgcggaaagaggttatatacggatggtttgtatacacactgtaacaatcgcattggatgtttggcatgaggtagggtccggtacaatccactgctatggcttttgttattttaggagaaatatcggaataggcaccggaatctacctggaaaatcatttcagccgccgtgatctgaccatttctttttgctcccagcctgattgttccttccagtcccagatgacatggagaagtgaccatatcttcctctctcgtatttgccaggttgatccatttaccctttgcattcatcgccgcaatcactgcaagcacctccagctgtacgctggcctttccgccaaacccgccgccgacaaacggaacctggacaaccacctttccctcaggaatattaagatatttactgatcagttccttaacctcataggggactgggatgaggtttttattatcacactgtcatccggcatgaccatacagtggaccgccctggtctccatggcagcatgatcagactgtggcagtgaaaagctgccttccacaacaatctcgctctcctgccagccttttttcatgtcaccttttctgattttttgatggtggcagatattggtccccttgacggggtaaacttcttcaataacttttgtatatgacatgagagcctcatgaatcatgacaggatttcttttggccgcctctttcacagaatttacaaccggcaaaggctcatactctgtcactatttttccagcagctgcctttgcatgcatttcatcatctgcaataacaattgcaaccggctcgccgtaataacgcaccttttccctggctaaaggaggcctgtcccgaaacaaagagccgcacatgatctgatggtcttttgcagtgatgaccgcgatcacgcccggcatttcagatgcttccctggtttccatggataagatccgggcatgagcatgaacacttgtcaataatctggcataaagcataggataatcggtcatatcatttgtatattttgctgcgccggtcaccttatcctttgcttcttttcttaccgtatcttttcccaactgggcctccattggtcacctcctaaaatattctatctgcttattaatatatggtcaccgtttttcagctgcaccacattggcgcgaagtgcctttcccaaatcagtcagataaatttccctctcttcaggatcaggaatgtaaagagtcaaaggatcgcctgatatgatcctttctctgttatctgttatataaactaatatctccggattactctgtcccattgatacctcctcctatatcaatatccataatcgtattgatttttctgctgttttccaataccggtgtttttttaatcacatctattatggcttcaggatcccggatgatcggcacaaaggccagcagcagctttcctttagcataactttttctggtaaaactgtaccgctttacgccaaaggtccgggtagcctcaaaaagcatggcctgtctctggccataattctcaagtgtaattctgaatttattgcttttcggctctatgacaatgccaattccttcttctaaaaacaactcccggcttttccgggttcccagcacattggttacgtacatgccgtctaccagcaggtctgaatggtctatggttatttttccctcttttatgttgcagatatcaccaatgcacttgccttttgttatccttgtaagaatataaatcatacacaagccgctggcggctgcagccaccatattccatatgagattgtccaaagataaaatgcttagaaccaatacaacaaacagggatgtgagaagggataaataatttctggattcataggtctttgcaatgccgtcaatataagcggctcctctttttgaatactctgttttttccagatcctcaagactttctttttctgtttttctcacctcccggaaatgctggatggctaagccgatgaaggtaacagccgtgaattctttgtttaacagagacggaatcgcaacagagcctaatgcggatgccagaatacctattacaatgctgataaaaccgccggtaggataactgggattctgacgcgtatcaatgcgaagggtgatgatccgcgcaattgttcccattacgatgccgcacaaaatgataataagatcatgaaacgctaatgttttttccatttttttataatggcgtcacttgtgaaaccatattgctccaatcttaattttggattattatctccttttcctgttacaatatgcaggaaatagaaatactggccattaaagggccgcattaaactctgttgccataatcataccagcaaataaaacagcaattttcattaagtaaatcgtaaacatattgtaatgccaaaatctggattctgctgttatacttatcttataaaaagcaggaggtcaaaacatgaacaaatttttaaagcttttattaaccggcatcagctccctggcactaatcctgccggtgagtgggattatagcacaggcagaggagccggctccgctgcccagctccatacgcatctacggaacagtaacctgggtttccgaaaacggactccgtgtggttcggaaagacagtgccggtgcagaccaggaaatcatcctgaacctttcctctgattcaaggattttagattccgtcagcggagatcctgcaaacgtgggtgaaatacagaaaggagaattgatctacgctgacatcagcccggttatgacccttagtctgccgcccatgtcgaatgccattacagtgctttgcaaagtcccggccgactatcaggttccggaatacgtaacggtaacgtctatgaatataaactcagacgggaagaccggcatcctcacctctgatacagggaaacaatacagtgtaactgatcaaagcaatctgtttccatatttaacccgtaacattgttacggtccatgacttatcaaaaggacgcaattgcctggtgtggtcgaaggataatactgtttctaaaatcatggtattcccaaattccggcacacctgatatgcagaccggctggataaaaaaagacagtgactggtatttttatgatatcaatggtttactgtatacaggatggctaaatcataacggcgactggtattacctggatcctgagactggaattatgagaacaggattcctcaccctggagggtaatacatactatcttcaaaaggacgggcgcatgctgacagctgccaagacatttactcccgatgaaaacggcgtattaagatagcttacgatgtttactgcagggctttttcaccggaaaagcagactggcattttattgatacatttgatttataatatcttaaatgagaggcggcagaagaaccttgaccggggattctgccgcttgcttatggttcggttgcgaacatacgttctttagtgattgttttttagccggggtctgtgccccggctgataataagtatttcctataaattcattgttttattttgccttccttatagtgtttgcggcacaatgaaacatatttatcattggcacccattgacacctgctgccctttcctgactacatttccattttcatcaattcttgcattcatattagcgctgttgccgcaccagcaaactgttttaagttcctcaatttcatctgctaattccatcagacgttttgaacctggaaaaaggtgagaggtaaaatcaatcctaagaccatagcaaaaaaccggaatgtggtattcatcaacaatattggaaagccggtcaatatcatcttcagaaagaaactgcacctcgtctacaatcaccgcatctaactctttgaataacttatcgccataatttttgaattcagaccacaaaatacaatctgcttccagtccgatccttgacttgatcttcgtttttccatccctggtttctatatcaggttttacaagcaaaacgttttttcctttttcaatataattatatctggtcattagtgcgtttgctgtcttggaactccccattgccccgtatctaaaaaataatttagccatttatttctcccttacactgtatcattaatgaatatcgtattcttgctctgatgaccggcagcttcttacatatcctctaaatctatttcatcctctaactgttgttccaaacgaaaaaccttcatatattcttcaaaaatcagttctgtaaccaggtaaaaaccaatccttgatgtaatatcggcctccctgtagctcagtttcctaaaataggcatacaggcttaccacactgctgccggaaatggggttctgactcattcctgtaagcgtcacaatgggaactcccctggtctgggcgatgtaagagagcttacatatgatatcggtacttcctgaataactgatgaaaaaggcgatctgtccaggtaccaggttattggcatacaggatgcagttatcacggtcatcagggacaatgatgatcttatttaaatgctcaagcttctttgccagatccaaagccacgatcctggaaaggcccagtgcaaaaaagatcacctggcggctttcatagatcaatcttgccgttttctcaatgttctgccgcgaattaatggcaagtgtctgctttaagctgtccataacagacgtctgttgttcagcagtatctattccatactgcttccggtcatgtataatctgatatttcagctcactgaacccgtgatagcccagttttttacaaagcctcacaatagaattaggtgacaggtataactcttcggccaccttggcgatctttaaatcctgcaatgcgccgtaatgttccaataaataattgacaattctttcttctgtaggattcagttttattcccctgtttgacagctggtcaaaaaaattcatctttcaccctccggagcccttttctcttgatgtgaaataatacacattatgtgttttattatacttttcgtatataaataataatatacttccaaacacttgtaaatcaaaattaatccgatatgataaagctataatttcatgccggtattgaaatcattatattaaggagacggagggtcttaaatgaaagagttttggcaaaaattcgggaaatcgctgcttctgcctatttccaccattgcagtcgccggtatattcagcggacttgcagcagcaatgcagaacagcgcaattgtaggggaaacatttgtaaatcttgtatacgtccagaattttattggttttatccgtaggctggccggactggtattcggaaacctgcctttgtttttctgtatatccattgctatgggaatggcaaaggatgaaaagccgaccgcggcattttccgctgtcctgggcttccttgtatttcattacacgttaaattacattctgggactaaagggcatcaccgctgaaagcaccagcatcagcacgctcatggaacaggggatgtcccaggtggatgcaaccattgtaaatgccaagtatgagaccatgctgggatatttcacactccgcatgaatgtattcgggggtattctggtaggacttcttgtaaccgctttacataaccggttctacaccatcacgcttccaagcgccgttaattttttcggcggaaaacgctttgttccgctgattaccattatcaccattccatttgcaggaatcgcatcttatttcatctggccgttcttcaacaccttcatcggactgatcggaagctggatcaactccattggagtattcgggccatttgtatacggtgctgccaacaggcttttgatccctaccggccttcatcatattctaaaccaggtagtacgctttacaccggtaggcggaacaacaaccattgatgggcagaccgtcatgggcgcattaaatatttttaatactgccattgcatcaaacagccaggtccccaatgaagtattccagatgggcgcccgctatgtgggtcagggacactccctggtcgtcatcttcggccttccggcggctgcctttgccatgtaccggtgtgctgatgatcagaacaaaaaaagagtcaaggcactgctctctgcaagtgttaccgcttcaatcctgacaggtgttacggagccgctggagttttcctttatgtttatctcaccggtgctctttttattccatgtaattatgacaggaatcggctacatgacggctgctttgctccattgcagtgtcgggggagtacaggcaggactgattgactttactattttcggtattttccggggagcacagagcaaatggtaccttgtggtactgatcggaatcggtatggcggttatctactactacggctttacctacctgatccgaaaatacaatatttccactcccggaagaaatgaagggtctgatgcagaagatggagaaacggcatttgtgaattccggaagcggcacaaagctggctgaacagatcctggaatatttaggcggcagagaaaacatcagtgagatcaataactgctttaccagacttcgcgtttccatcaaggataagtcactggtccaggagcaaaatttaaaatcaaccggcgcttcaggcattgtctgcccttctgccaatcaaatacaggtcatctacggtttgaaggttgaaagcattgcaagagatgtgaaagcattgtatcacgctcagcatacaggaaaggattaaaaaaagatgaaacataagttaaaaataacgatcgtgggaggcggttctacctggaccccgggcatattgaatgcatttatccgccacatggacactctcccggtcacagaactggtcctttatgatattaacgaggaacgccaggcccctatcggagaatatgcgcagctgctgtttcgcctgcacgttcccaaagtaaaagttatttatacaacaaacaaagacactgcctatgactccgtggattttgtcatggttcagatccgtacaggcggatatcacatgcgggaaaaggatgaaaagatccccatggaatacggagtgctgggtcaggaaacctgcggccccggtggatttgcctatgggattcgttctttaaaagacatgatagaaattgtaaaggatgttcgtaaacacagtcaaaatgcctggatcttaaattacaccaatccagccgctatcgtagcctacggcctccagcgtgagttccctgatgataataggattctcaatatctgtgaccaaccgatcaacctgattcattctttctccaagctgcttgatgtgcccgccgaatccctggaacccacctatttcgggctcaaccatttcggatggtttacccatctttacaatcagtatggccaggatctgcttcctcagctgaaggaacagataaaagataaagggtttctgcctgccgatgccgccgagcgcgatccttcctggctggatacttatgcattggtaaaggatatggttcatgattttgatgaatatgtaccttctacctacctccaatactatatttatccagaatacaaggcttccatgttaaatccggattataccagagcaaatgaagtcatggatggccgtgaaaaacaggtattttccgaatgccgccgtgcagtcagccaaaacagcctggatggaatccatgtagtaaaaaatgaagctcacggtgatatgatcctgtccatagcggaagccatctatttaaataaaaatgcgtactacattgttatggttaaaaatgaagggatcattgaaaaccttccggatgatgcagttgtcgaagtgacctgcctgctgggcagccgcgggccgaaaccattccacaccggacctgtctctgttttttataaagcattactggaaaaccagtacgcctatgaacgcctgacctgcgaagcttattttgaaggcagctacacaaaagcactgcaggctctgacgttaaaccgcactgttacagatgccaagaaagcgagaaagattctggaccgcctgattgaagaaaacaaaggctactggcccaggctggcctgacagaaaggaccgtatttatgtgtaaaatgattataaatgcagatgacttcggctattgccgggctgttaattacgggatcgtggacgctcatctccatggggtgctcacctccaccacacttttaaccaataccccaggcttccggcacgctgcctccctggctaaagaatgccccttctgggagtcggcctgcatttaaacatcgcccttgggcagcctcttaccaaagggagcaccctgaccggagaagacggagcgtttattaagccgggaaacttaccctcctctcatatttatctgctggaagatatccagacagagctggaggctcaataccagaggtttttagaggtaatggggaaaaagccgactcatctggactctcacttatttacaacagacagcaatcctgttatggctgccgctgccagaacactcgctgaaaaatacaggctgccattgagaaatcacgacataccgggctttccccacgtggattttatacaattccgcacataccacggggaaccgggactgtcttatgtatacgatcatatggacgatatctcttccaggccatatgtggaactgatgagccatcccgcttatgtggattcttatctgctccaatcctcctcttacaatttgcagcgccttgcagaactggattttctggttagcagaaaaacaaaagaaatgttcgagagctattcggtggaattgatcaattacagtcagttgtgatcatgtgacattttaacggggactatcggtactataacacctgttatataaggaaaatcaaacttgctgtcctcccccggacatctcaaaatttgtgtaaacctccaagctgatgtaaaataatgatgtgatcccaataagttagattgttaggtctgacatttgggggtcggttcataaaatcacttagtttggaggtttattctatgtctgaagctccgggaaatcatttccccattacatttggtttatgaattattttcaacattattattctcatcctccaaattactcctgtgcttggtaaataaatttcttacatatctaaattaacgattattatatccgatgcgaaaacttgcatggaatgtaacaagcacagcattaggacaatattcttttatgtctcacattattttgcctggttagcttacagttttttcaaacgttctgaatcctttttctaatttctttgtttaacacaatatgcatacaaatcctatttgattaaatcactgcattttctaagtgcttcaaatcgataacacagatctttttcgaacatatgtttgatttttatttctgaatatgttatactgcttttgaaaagatttataaggagtaattattatggaaaaacaaacaaaaaatgatgagtgtttcgtttttattgaatctggattaaatgcattagaaaacataggctggtatggtgaaacaagatttgtatgtcctatatgtggatacaataatgcaaatgccagaaggattaaaacacctgatagaattcgtaataaatcgacctggttatattgtgaagaatgcggaatgcttgttcatggataaattctaagaggcaaagacataaatgtctgcctcttagaattaaaaagcaaataccggttttgtgtacattaaaagacaagactactaacttaatatcttagctagtggtcttgtaagttttaactgagctacatatatttctcacattctcggttgggcatatcccattcgacatattgaccactttaatgttgttcctttaattctatcagaaatatcccatagatttttttcaactcgtagttcaacatttttttcaaataaagctgcaaataaatcactaagtgtatatttagcaatcgctacttgtctcattttagatatataatatcctgcaattcaaaatcttccggatcgaactcatatatgaataagcaggtgctgttcatctattgcccatacttggattttatatcttttatgccatcgcattaaattccgttctggtaatggaatatacgcttgtctttgtgtttttctcgtctgcatattcctcgcgcaatgacatccccattttttcggccacttttcttgctggagtatttgtccacttttgataagaaaatatctcatcaaaagccatgttttcaaaagcatacctcagacatgcttttgctgcctgtgaagcatatcctttgcaccaaaattgcttatcaatatggtagccgatttcaggaaataaattgccatcaccatgaatattctgcatagtaattccgcaatctccaatgaactggtttgtttcctttaaaataattgcccataatccgaagccatatctgctatagttttcaagactccaatcaatccaacttcttgttttatccatatcaaatgcgcttgggtaatattgcattgtttcttggtccgaaaatatttgatgccaagctttaaaatcgttcatagttagttctcttagtgcaagctgttctgtttctattatataatcttccattgtttcgtcctctcataattccttatttgattgttaaaataatatcatatacagccgcatctttccaacatatgccattcctcatcatcaatggtatcaaaatccgtaatcagacagcaaagctcatgatttttatcatatccccaataagaagcataacagccatccccataaccgctggaaaatacggtcagattattgtctgttccgggaagattgtaatttgctgcagaataggtgtatacatagctgtcgtccaacgctttttccagttccggaatcatgccgtcatcaacagtcccaatgagtgctgtaaactcaccgcaagtcaactcgtccataaagccgcctgttccgctgtctactccatagccgtaatattcatcttcacttaatttttcagcatcttgcccttttatgagtgcaggttcaaaataaacaggtgaactttctgtaaagcgtatttccgcaaatgcaacgcgacggtcatcttggatatgctgcacatagagaaagaccggatattgaccgggcttgacagctttttcaaatggctctgtttcataaatacacaacgggtcatttgcaacaatttttcccgtgggaaggttgagtaagccaaggggctgctcctcaattttctcatgaaatttactgtttataaaaaacttttcactttttcctgcccgcaacagcttcagcttgtttatttgtttgtccattcccatattcttatctcctcgtatggtataaatgattttcatgagtagaataccatcatgcttacgaactttcaatagtcaatcggatattcgcagtgaccagggcacagcgctccccgctccccctctcaaggatggcaggcgaaaaagctgatcaggagttattcctgaccagcttgaaaaagatttcattgattgctatgctatgatgcttttacttatatccagccattccaggtatcagagttgacagccccggaacataagtcaccagcatcagtattatgaatatagctgcataaaatctcagcaatatgggcatcacattttccagctttcttccggctacttttattcctacaaacagtatgtttcccaccggaggtgtaatacagccaatagaaaggttaaatacaagcatgataccaaaatgaagcgccgacattcccaactgctgacagacaggtaataaaataggagtaaaaatcaatattgcaggtgtaagatccataaaagttcctacaaaaagtaaaagtaaattaatggcaaataaaatgataatcttattatcagaaactgataaaacgccgcttgcaattgcatctggaatacctgtaaacgacatcacccatgccataatatttgatgtgcctaccagaaacataatgatgcctgacattttaccgctgctcaccaaaatagaataaatatcttttataccgatagtcttgtaaaaaaagacggataaaaccaaactgtaaagaaccgctacagcagatgcttctgttgcggtgaatacaccggcacaaattccgccgattacaataataatcagcaaaaggcttgggatggcatccagggtataattgataaaatctttaaatgtgattatttttttgctgacaaaattttgtttctttgcatatacaaatgcaatcaccatgcagctaagtccccacagaatgccgggaatataaccgccaagaaacagcgctgctatggatgttccgccactggcaagaccatatgtaatcagaccggtacttggcgggatcaataatccggtgggcgccgttgccacattgactgcggctgagaaatcttcatcgtatccttcttttttctcaataggcccaataattgcccccatggcagaagctgctgcagttccggaaccggaaatggcaccaaaaagcatattggcaacaatgttggtatgcgccagtgaacccggaattcttcctgtcagggcagttgcaaaattaatcagacgaattgcaattccgcctttattcataatatttcctgccaatatgaaaaacggaatcgccagtaaggtgaaaatgttgattccctggaacatctttaatgcggcagccggagctgctccgttaaaacctaaagactggacaataactgttaatgaggcaacgcataatgatatgccgatcggtactcctgctaataacaaaaccacaagaatagaaaatattataatacttgctgctgcggctgttcccataaccttacctctcctcctttgttctgtaagctgcaataagctcagccatattgatcaagttgaacaatatgatcagtatgccgctgacaggcagtatcacataaacgatatccatagttattcccaacgtgggcgatacctggattgctccaacactcataaagctgattcctcctgtcagtaagacccctatagctatgaccataaccagaatctccgacagcagagacagcaataattttacaatcggagagcccttgtccagaaagaaggtaagattcatatgatcacgttcaccaaataccagggctgccgcaaggagggaaatccatacaaaagaatagctgaggatatcttctgacatggtagatggatttttcataatataacgcataaatacctgatatattgtcaacagcgacataaagaccagcagtgatgctacagcaccgctaaggattctgtttaaccatgttttcattattaaaattgtgtgcatcccctatttcccctcctgtatttgctgcactctatcgtaaagcggctgtaatgccggagttgcagcgagcagttcttcccgtacccttttttgtacattttcaaatagagtcttatctacttcaataaattcaactcccattttttcagcttccactatacattcattaatttgcttatcccattcttcacattcaactcttgtagcaaggtgaaaggattcattcaataccattttttcattttcagataatgaatccagaaatgctgtattgcccaccagcatatctgtaaaaatctgatgctctgtacgggcataatattttgcaacctctccatgcttcatgctgatcagagccatttccggattcatagctgcgtcaattacatggttctggagagccgtatacacttctccataagccatgacaactgctgcggcgccaaatccctgagccagtttcacatttgcctcactggattgaattctcaatttaagtcctttaatatcatctggtgtatgaatcggttttgaggcgtaaatgttattcaccccattggcaaaccatgctactccacgaatccctttatcagcggtacaattataaatctgatttttaaattcctcatcgttcatacatttacggaaactctcctcgttataaaacaaatatggaagtccaaatattttataagtatcgtcaaaagattctaaattgcttccactggtagcaacaagatttaaagtccccatttgcagaagctccagggcttcactgtttcccccattattccgttataataaatcttcacctccacagcgtcaccaagctgttcatttatgtaatttttcatagcccgtaagccaacactaattggatgatcttccggctgaacagttgcaatacttatgatacgtttttggctttctgcctggccagccgcagtttctgaacacgcattaaggcaaagggtcattaagaagaccaataagaataccaatgtttttttcatgtttaatacccctctgaaagtttaataaactccgtacaataactgcatactcaccacaaccccactttaaaaccgtatagcttaatatctgagcctggactgactgcacaggctcagatcacatgaatttcttacaccagtagttctccatctttcataatcacaagtccgtcgatatcacaggtaatctttttcattaccagatccatatgtaatggagaatcggtatgtccgccaaacatcaggttttttccaattccaatatggagatttccaaaagaaccttcatccggtgccatatggccgcaaagaacatttttttcgttaagcccaagaccgagttcgcccacattatatacagacggatcatgatagtcagccaatattttacgtaaaatgtccgcttctcttccccctctgacagcaacaatcataccatctttcacatctaagtatattggttcttcaatcagattaagctgaggatgtgggatgcttccgtcaattacaataattccattggcagtgccttccaccggccctaatgcgacctcagcattaggcggaaatgcagcagaacccgggtgaatagctgtaccataatcaattaccacattacgtcccttgacactgcataccagattggttcccccttctgatgtaagggtaaaggtttctccatgaaatttctctgcgacccggttaattaccttggcaacttcatcaaaatctgcagtcagtccccctgtctcaaacatatcaagtgtataatcctgcactcccacccaccgcagtcttcctgctttacaagcttcaatacgtgcttggctatgcatcaacgacatggttgtacatccaaatgcaacgtctacatgtttcatcgctgctgcaattgcccctgtcggctctgcaccgtgtcctgcagtgggcggcattacaaccattgttgtttcaaagtattcttttgcatacttgtaaaccagttctccaatttccctcttattatcatcagttataacaagaaccttttcatcctcttttaaatgtgtaacggtggttaataattgttttactcccaacggcatgtctttggacatttctttcattttctgtctcccattcctctacaatatttgtctgctattttacttctacaataagttctacttccactgaagttcccccggaagtgatgcagcgcctatagctgcacggctgtgttttcctgcctcaccaaacacctgattcacaagatctgaaaccgaattcataacaagaggctgatctttaaattcaggagtgcttgcaacatatcctttgatattgacaatcctgatgatttcatctaaatcccctgttaaatccttaacagccttcaggcaattgacaaatgcagccctggctgcttcctgtgcctgccggacattaacatctgctcctgcaactcctttatgaatcagctctccgtccactctggcagcatgtcctgagacaaaaaccaattggcctgtacgaactgcactttcaaatggccggacattaggtgctccttttccagtgagcgaaaagcccgcactatttaacttttcctcgtaattcattccattcccctcctttcttaatttatcatcaatatatcataccttttttagaaaaactaatgccaattgccctcatgatttattgatattgtctatagattttaattccggttcgaatttgtactgtaattatttctattttcattttagtttttccttttttttgatatactaattaaaacaacaaagtcagagggtgaacacttgaattttaataatctttattactttgccgtattagccagttttcagcattatacaaaagctgcggaatatctctgcataacgcagcccagcctcagtcatgcaattgcttcgttggaaaaggaatatggggttaaactttttgaaagggatggacgcaatgtaaaactcagtaaatacggagaattgttaaattcatatatttcaaaaggatttaaagaaatagaacacggcaaccggttattagatcagtttgcatataaggatgccggttatgttgatctgagctttttatttgtattgggttatcagtttgttcccgaattaattaagagttttaaccgcaatgccggttataaaaatattacgatcaacttgaagcaatataatacacaagacagtatttccggattaaaaaacggcggtattgatatcagtctgtgtgcctttatttccaatgagcctacgattacattctttcctgttttaaaacaggaactaatctgtatcgtgtcagataaccatccactggccggttatgattctgttgaaatggaacagctgatacagtatccgttaataaaatatacggatgcagtaggtgaaattcaggatgtgattgataagctgtttgaagactgcagcagttatccgcaaactcagaatttcctaaatgaagaaattaccatagccggtttcatatctaccggtattgatcactgcattgcaattgttccgaatctggaactgcttgatggatttaaaataaaaaagataaagctaaatcatccggatgcatatagaaatatctatctggcagttgccaacaatcgtccaatggcaaattgtgtgaaacttttttatgaatttatcattcaaaaatgtacataaggaaactgccagccttatatagactcagcgaacatagccatttatttttaaatttggctgcaaaaaaagacgggcagcttccatagggagtgcccgtctttaaacatttataataatcctggcaaatgcgcctggaacatggatagtatgcagacaaatatcagggctgccaccccagtaataaaaccaccgatcgtccatgcacggatggtatcttctaccgatatcttataaaaacggttaattgcccaaaagccggaatcatttggcagggataaaccgattcctccggcacaaatggcaataccgcaaagaactggcgatacaccgctcgctgcaattagtggtgcaaacatagaggaggtggtaattaacgcaacacctgtagaaccctgagcacaccggagtatctgtgaaataatgaaacaaagaaccaggaccggaatatgaaactgcagcagagaagaagcaatgaaatcagcaattcctgtggactgaagcattttcccaaaagctccgcctgaaccggtaatcaaaagcaccaggcctacttggccagccgcatcattcataacttctccaaccgtttttttcaaatatggcagagaaatcaacgctgcataaataacaccaatcaacatagctatatttttattgcctataaattccagcagtgtgacaagcaagctcccttcctgcaacaccattggtccaaaacttccaaaaaggattaaaacaatcggaaccattaaaattgataccgctactccaaagccaggttttttatctattccgacaacactgtcactttctttttcaaaatcttcaatatcttcaaatgcgtattcgtgatgatttttctgatcctgccagtctaagaatttcccatagccgagtccgcctacaagcgtaccaaataatccggcaagagcggcataaaggaaaaacacaccatagtccagatgcagattctccgcaaccgccattggattgggagttggcactaccatcgctccggtagcaaccgttgcacatacggtcgcacaacataatgaaacgattgatacttttgttttttttgaaatcacccgtaccataggagcatacataatatgtaccacatctccaaacacaggaatcccagtaataaatcctgccatggatactgcaatccgggatttctgaccgttgaatttttttaaaaatgtatctgcgattacctcgatccctccggattcatacaaaaatcttcccagcataacaccaagaccaatgataacgccaatgctccccagtgtattaccgaatccgtcaccaattactttagaaatatctgcaacaggcattctcaccataaggccagttccaactgttgtcaccagtaaagcgataaatgcatttactttgaatttaataattgttaccaacaaaattgcaatagcaataaaaaagacaatgattaaccctatccctgtaatcatttttaacctccacctagttcttttcaaacactcctagtttttccagacctttttccaagcatagtttctcttcttcccccaaatctctaaacggaaaccgcgccggtcccatatcaaaccccttcagttttaaagcttccttgtgtgtgatcgtgggcataatggaacggaacaattcacgaatctgtaaaaccgttttctgcgcccgtcttgccccttccaaatcaccatttctgtagccattccatatttccagcgtcagttccgggtacacactggcaatggcaataattccacctgcagcacctgcaaagagagctgataaaacctgggcatcatttcctgtaatcacttcaaaatcctctcgctctatcactgcctgataattcagcagagtcataaaatccatactgctgtctttgattccgcatatatttgtacatcgttctgacacttcctttaacattttggcagttatggggttgttggtcatgccgctcatattataaagatataccggcaaaccttctgcaatatttgccaccttttcaaagtattggcacagtgctttttcatcatatttatgataatacggtgccgtcactgaaactgcatccgctccttttttctttgcccattctatcaaagaaaaaagttcttgttcattcatggacgtgacattaaacagcaaagtcgtttcttttcttactccttcctttgcagccagcaaaaggtttttacgctcttctatgcggagattgacaaattctccgctggtgcctcctacaaaaatcccttttattccacttccagctatatattcaatcaaccttgtatactctgttgtattcaccttaccattttcataaaacggggtgagcactggtgccgaaattccctctaatgttactagtttcatccactatctccttactttactttaatattgccccttcatccgcagaagacacatccctcgcataacggtaaagatacccctccttaaccttatattgaaattccggaagacgttccaatctctcctgtatttcttttttggaaagttcaacagacaaaattccttcatcaatatcaatatggatcatatcaccatccttcagtgcggcaattggtcccctttgggaggtttccggagaaatgtgaccaatacacggtcccctcgtagcacccgaaaaacggccatccgttattaacgctactgtttctgaatatcccatacctacaagcgcggcagtcgctgtcaacatctcacgcattcccggtccgccctgaggaccttcattacgtataacgattacatctcctgccttgatcattccgctgtaaattgcggttaccgcatcttcctcacactcaaagcagcgcgcaggtcccctgtggtttctcatctgtgccacaaccgcactctgtttgactacgcagccttttggagctaaattaccatgaagtacggcaattgatccttcctttgcatatgcatttataaccggccggattatttcctgattccatacctgcacactttctgcattctgtctgtgagtttttccatttaccgttatgaggtcaaggttaaccatctccgaaaaagcttttaaaacggcacctacccctccggcctcgtcaaaatccagcatagtgtgtattcccgatggttttatcttagccaggtatggcgtggtttttgacagaagacccaattcctttacagtcatatgaagctttccttctttggctattgccggatagtgaagtgtaatattggttgatccccaacgctgacacatactcttgctgacaattccagcatttcctggctgacaatatctcttggacagatttgtttctctacaagacgtacgatttcaattccactctgcctggcaatccgtttcttttttcctgacaccgcatgagcaccggcacagcccggcagtgtaagtcccatagcttctgctgcgacagacatgctgttggccgttcccatcatggcgcaggagccaggtcccggagacataatcccttccatctgttcgtactcttcctttgatatttctccttttgccagcttccctgccatttccttcaattcataggtcgcataacttttaccttgatatacggctggcatcattggtccgccagtaaccaatatagctggtatattgatccgcaacatggccatcaacatagccggcacgatcttgtcacacccacctaaaagcacaagaccgtccagcctgtgagcattggcgtaaacctcaatggaatccgcaattacttcacggcttggaagtacgctgcacatcccaacgtgcccctgtgtaaatccgtcacaaattgaaatggtatttacctcgaacggtagacctcctgcctctaaaactcctgctttcacctgttctgccattttatccaaatgaacatgcccgggatgcatctcgttatgagtattaataacgccaataaacggtttgctcagttcttcatttaacagtcccattcctctgaaatgcgctcttggacctgccatacttattccattgactacaacagagcttctgtatcggtcatccttataagaaaaatcttccatatgccctcctaaccttgtaatttttctgtaattgatgctgcactgtgttttacttcttctgcgaaggaacatgctctctccggggaaaagcggtaatctggtgcggaaatgccgatggttcctgccagattgccatctggtccgaatatcggtgccgcaatacagacaatatccggattatgttcccggttatccagcgaatatccctgcttttgtattaattccaattctctgtaaagtgtctccttatgcatgattgtattgtctgtatactgcttcagcggattatattttaaatagttttccacccattctttactatggccggcaagtatcaattttccgccgccagtacactgaagaggaatcttccacccaattctggatctgagctgaatctgatttttggcatccagctttcccacatatactgctttgtcattgtcaggggcaatcaaatggatcgtttccaaagaaagctcatttaaccttttcatctcttcctttgctgcctcaagaaggtactccgacagatttactttcaatgtaatattcatcatgcccattccaagcctgtactgtcttgcttctttatttttcacaacaaatccgcatgcctgaagttcctgaagaatccgatggatggtactggggcttaatccggttatttccgctatatccccaatattcacctctccttttcgctctgcaagagccataataatctgtaatgcttttaacgaactgtaacttttcattttttcctgaaggtccatggcaatcctccattccatatatggaatataatatttaaatatagaatcaattgatacagccattataagtggataaaattttatcgtcaattgacaataatcaaaaaatgcaagtggaattttggttattttaaacaaaatttttctattgtttttggttgtattttatatatagaattggccgttttttttacttattattattccatatataaaacgattcaattataacaataaaaaaaccaatcggatccatacgtgagaaaaataattttaatcccataaagattatgaatctaaagcaaaacggttcgtgtgtttatctgattcgattaattgaaaagcggcatctcacacagtaagatgccgcttaaaatcattttttaacaactgatattttcctgattttatgtgccctgcaggttccgtttttgatccttgcttgatctaatgatgataatttacgtactaaatcaaaagtctggcagttgtctgctgtttttccctgactgtaaattttttcaaaaaatgatatcaatcagtaacggcttctattaagtacatttaaaagtcaattgagtacgaatttaaccttttccatccatgtgtatattagactcactttgatatttttttaccaaatgattccagtaatgcttaataacaatttattggcatataaagcagatgggaaaagcaaaagtggtatgtgatttcttggcaaaacaaagattcctgttgcagaacatgatgcgaggaaaggcgctccccaaataaacaggtatttgtatggcacgcggcatcgtcatattattactcattgtctgaagagagatcaatgattttttccacaataccagcatctgttttttgtagtggcttctactatactgggaaaggtaaaaactcaaacaataaaccgtggagggtaaacatgaaaaaattaattacactattattcgtacttacaatgtcggtcagcattgcggcctgtggaaacaaggaaacatcttctgcgaccgaacagtcttcccagacggaggaaacctcagaagcgcccgcagagagcgaagttaaaagcgaggttgaagccgcagcagtcgtattccctgacttggacggattcaccagggaagtacagtccaccatgggaattgatgtgaccatgtatcaggctgaagataattccgccattatcgtgatgggtatgccaggggatgaggaaacctatcagttatttgccaccagggacgcagaagcggaagcactgctcaatgaggcagcttgcacgcagttggaacagcaactatcccagatcattcctgattttaaagcacagggcaaatttgaaaccgtagaaggcaaagaggcctatgtcatcactgcgaacatccctaaagaacaggcaggtgcagcaggtgcggacatcgacatacattattacatgattgccaccaaagattctatttacattgtgattggcacatcgctgggtgcagatattgttgaaggaataaaaagtactatctctttaattccttaacatgttactatacatttcggttataacagaccgttataaccgtctgaccatttaatgaaccagaagtattttgctgacacagttttaccacatgtgtcattagtagatattaataaaaaagtataatgattatgttataattgaaaaaatcattgaaatttgttacctcaatgatgacggaagacaaagtcaattatataaaacagtattgaatatatgctcataaatattcaatactgttcctttgtgtttatctatgttataatttactaaatcagaatttaccgttcaaagtattgttcattttataacacaatagaaatatttattatgaaaaaattatttcgggtgatgaaaacctacttaatacttacctgagtagaaaacaatgtgtatatatcggcacagatattgtaaaataatccctgtccagataacgaaaaattgattggagataattttatgaagatataattgctttgtgccaaaggatttgaaacaatggaattcagtccatttattgacgtgacaggctgggccagagatgattttggccacgcggtcacagtagaaacatgtggatttgccaaaattgttaccagcacatttggaattcctgttgttgtggataaattaattactgaaataccagcttctgccttcatatcattttacattggttctactctgcagcaattaattacagccaccgtttttaattattgcaaagcttgtaatgattcattcacaactaaatatttagtaatctcttcaaaaaaagttagaactggtttacaattagttggcttgacagatcctttcgataattatacaatgaagttagttttcgctaaccgcttgaaaggaggatatatgaaacaaatggatattaaattatacaaattaaaagttgtcaaaggtaaagagaaaacagccaaagagtggctggcttttctggaagcacataaagtcgagggaactgagacccttaaaaatgaattggcttattttgaagcctattttacagcagtagaaaatggcatcatgtatatttacatgttttttgtcgcaaaagatgtgagctattccaatactattgctggtaatagcaaaaatgagctggacatcaaacattttgaatacatgcgaagttgtatcgacctgaccgccggggatatcatggactgcgctttttatttggataacctggaagctttaaattcctattaacaggtgattttgtatcaataccatagatttttgttgtatcgtgcgttactgcatacttttgctttatatattttaacgagctgctatcaatcatggcattttccttcgttttggtatgggcgtaaaatctccaaataccggctattggaatcctttctttaaatttaagaacctgtattcaaagatacacgattccacaaaatgtttttacgaatacaggttctaatatagggtttgattttttgttcagtagtaaatcatttacactatttgtcatttctctgatgcatagctgtctaaattctttcattcataaagttcccctttgcactcttacaggctccaattctaactgatccaaatcactccagtagagaccataccggatagactccaggccttttgcaccgaccacaataaaaccgtatacattcgagttcatttctgcaatgggatagagattagaaatccacaatccattcagatccggtttttcagaaagcttttgccgaattgacatggcttcttctgaataactccagaccagattagaatctgtataatcctgaaatctccccaccaattccagttttccttcagcgaagagataccgaaaagtaacaggtatctcattatccgatgcatagcatttcggtgagattaaggcagtatccctgtctgcactgatgtaagaataatgatccccctgagttgcgttagcttccagcggttttaagtcaaggctttgtttcattacccagttatcgctgtttttttcgcatcgaaacaagcctgcataactatgaaaaacaagcctttcactgtcagcataattgagttcaatcccatctgctcccaggagtgctaagtcagagatcaagaggtcataatttactggttgcgcaattaagtctacagctgtaaacctcagccattcatctgccaccattgcaaccagttctccatattcttcttccagacaatatggtgttccttcactaccaaaattagattgctcatgttctgtgggtacctcttccgggtctacggaggacaaaatatatccatctacacagcccgaatcccccatcggttcacccagtctgcttaatagtcgatagagctgtccatttatatacagcatgggcagtgctttttctgttgctgccatctctgctgctgccatctctgctgttgtctctaactcagtgataactggcagtgaagcaattgtggtttcagaaacggtgtttaccgtttctggattaggaaacttctgctgttggaaacatgcagttaagccaatgattataatagctgtactcagaattatgatatatttactcaaatactcacctccggtaatttattttcgaactttctttctattataacaaggtctttgttttgactttttacatttttcttaattttatatgatataactttgatgcaaatagaatagcaatttactgaagtaatattacgaaaccccctcgcatataattgaatatccgtgtattcttccaaatctgtaagttatgccggttatatgagtattaacgcgccttctgctatagattcgaatattatttcaagaattagaagtgttccaaattttagcctggaggacaaggagtattaacaggaattgtagatacgggaatagattacagatattttatttacctggataaatattccactgtaacagcccataattatgttaataacagtatataatttttatgcaagtcggtgatatcagaacactcgttgtaaagcctgaatttcagcaccaggtgtgaatgcatttggaccaacattaaaattgattattaatataggagatgttgtagaaatgaaccatatagtaaatgagaattataaaatttatttaataaccatggataaaagtgatcaattttggagggttatggataatggtgctagagaaatggcttctatgttaggtgttacatatgaatgggacgcccccttaacgagagatgtaaataaacaaattgaaatatttaataatgctgtagcagcgggagctaatgcaataatgttagcggcgagtgatcctttagagatttcaatggcagttgaagaagcgaaagcaaagggtgtaaaaatcatttatgtcgatgcaccagcgtttgaagaagcagtcataacctttgctacagataattatacagctggtaagatagctggagaaaatatgttttacgaattagaggagattggtgtcaaatatggttcaataggaatcattggggtaactcctgaaaacagaacgactgtaaatcgggaaaggggatttcgcgattattttaaaccgtttgccagttatcaaatattagaaacaatatacacgaatggtgacccagagttagcaaaacaagcaacggaaaaatatataagagacaatcccaatcttgttggtattttttcaacgaatgaaggatctacgttagggatggggtatgctttgagagaaaatgatataaatattatcggtattggatttgatatcacagaggtaattcaggaaatgataaaagataatactataaaagctatattggtacaaaatccatttacaatgggctatttgggtatggctcaggcagttgctgcattaaagggatttgatacaggtccacaatatattaatactggagtaactgtatttaatatatatacaccaagtcgaatactgtcataattaactatatttgagaaataagggaattaaaatgacacctgtaaaaagaaatcatattatgagtgatgaaaggttaaaaagaaatggacgcagcggtaccggaattgagacttggtactcagccagttgatgctgtattatccagaacgattgaatgaatatctataaagaaaagccggtcagacagtttgtcacaactctctgaccggcccatttatttccatattccgtcggtacttataatatgcccgatcttttcctaataaaacgcgaccgaggttacttgccggaccatgagctgttgaataaatgtaataccacctaggctaatccaaggtatcatgatctgtcccatctggcacaaaagttgacgttcggttagtgactggtttgatattggttacatcagtatttagtgaagtaactgtactacttaaattgctatttaataaattatgtaggtagaaaatataaataaagaagactacttaaaagcagtcttctttatcacgtggattatgcagtatgaacattaacagcctgtaatcctcgattaccttctgttacatcaaatgtaactgactgtccctcgtctaaggttttaaaaccgtccatcgcgaggccagagaaatgaacgaatatatcgttgccctgctcgtcacagataaaaccaaagcctttttgtggattaaaccattttactgtacctttagtcatgaaagatacctccttaaatattattattgtatttttactaaactaaaaatcgcatatatatgtaaatcatcaatagaataatgacttacgtatacatgcgaaatcaagaccttatttaaaatactgctttatcataacacaatgatttaaataagtcaattaaaaatcaaggaaaaaaggttaaaatgtgaaagtcatcaataggcataaagtgaacagcgcgaagtggaaatggcgaacctgtctgaacttggtaaatcatcatgaaactggggcttatccgaattcagtaaaatggggagaaaacattgttggagaatgctgaaaaatatagcaaaagcaatataaaaaagtttttatttaatgtaaagatgttttataagggtagggattaaaaatgggcaaacaggtttaaaaggtaatccagtgattagtcagatttcagctaaccaccagataccttaggagatcttcctcgctggtgactgtttcctttaattttactataaacccaatttcgtcttgcgttaaaacgatcctgtctgtggaaaaaaataataataaaaatagtggttgttttatatgggagttgaaatggtcttgaggtaataataaggaatgataatgagatgcacttgataaatgaaaattgggttagaatttctgctcatagataaacggaataacctcttcacgtttgatgttcaatacataagcaaactcctcacaaagcgctttttcagcatctttgagaaaacattcatcaaaaatctggagttttctgtctttatttatgttttttagctcttgtttctgataacgcaaagtttttatcatttttattagctcagaacggttaccatctgaaagaatctggccatataattctttgcgcttatgattatccttaatccaaattaaatcttcatccgacattttctcaactacagagaaaatttcatcggcagagagaacgtggcgaatttcagtctttcttttgttacttatagctgagacgtatactgtcgaggcagtattgtaaatgggtttgagtacataatatgaacgaattttttcatccatgtacatatcctgtaatccggtaaccttacaaataccatgatttccgtatatgatgatatcacctatatttatgatatctcacctccttctaacaaaataaaaaaatggttcactgaaactggacttacgtcactgcatagcaaaccacatacctgatgtttatattatagcacaattgtagatgaaatgtatacagtaattttatccaaaaaataagattatatgatgagctatctatttagtattttcctgagcaccgtgagaaaggggtatgccaaccgagaatgtgagaaatatatgtagctcatctaaaacttataagaccactaactatgatattaagttagtggtcttgtctttatttatacacaaaactaaaatataaaagccaaaaagaacataggctatctacatataacaattttataatgctttttttcataattattcacttataatcagctatagttgcataaatcagcaataatcacttataacaaaccaatacctttcattcacagttttttcacaaatcagagaaacggcttaaatacggtgcgttttgctgttttattgtatagtgccttactatttactttatcttaatatattttaatttcatatattttatttccattatcattataataatacagactttattgtcattacaataaccttaaaaatgttgagcagactataaaactatggtatgatattatctgcagggggagacacccataataaaaaacgaattgcacggggagacacccataataaaaaacatataaagaggtgatattatatcaaaacaaatcaaagtagtagattgtagtgataactctttagaaccaacttatccgaaacgcgcccggcaactgattaaaaatcaacgggcagattggatatctgaagatactatccgcatgaaactacagtatgtggagggaaaagtaatgactacagaaagtatcgtacaaggtgtgaattctataacaaatattaactctgaagacagccaaaacaatcaagctcctgatgataatactatcctagaacttgcaaaacgcagactggcaataaagaaaaacctattatcccaaactttggattatatgcttatcctattgtgttttgcttcattggccgtaatctgggattatgacacaaaagtattggtttgtattactttttctctattttgggggatacgtctactgtatcggatctttgtatttgctaaaccatcttttaaagatgggatcactgaatacataaaaaggagaaatgattaccaattggaatcggagtttaatcggctaaaaagggaatatttgaataatcattaaccccttttgctatctgccgaattaaacctatactttaagattgaataccggtgaatttttcgccggtattttttatcgtatacgagaaaagttcgtcctatacgataaaaaccctccgggaggatcgcactgcggcggcagggttggatgtcgccgcaggcggagaatcccgcaagcggaattctttcttatgcaatacctccggtacatgtagtataataaattgctatttatttctaaaaaacaaaatagtgattataatcagaatcagcattcctataataagataaagcggtataaagcgttcagattttccagctataaaaattgctgtggggccatctgctcctccaataattgagactgtccggcttatatagtatctctttataaaaaataataaaagccctaatgctgatatcattaatattaatccagctaagaatttatatattttcatgtaatcatttcctttcaagcatattttcttttattataatactataaagcttgcgtgtgtaaataattttataaaactaaggctctttaattgctatttaagaatatctgaataaaaaagaccatggtctatctacatatggcagtctatggcctttaggcatccatacaaaccacgtgtcatccaactcctgccgtcagcttaatatgcaagaagtgaaacagctgcactgctacttccagccggtgaatacctgctgtcactgaatccccattaactaccatatataaaagaacaaatattaaaatctataagtgaatgatcttaatacataatttttattaccagtgtgattttactatactctaatttcataattattcacttataatcagctatagttgcataaatcagcagtaatcacttataaaaaaccaacaccattcattcacagttttttcacaagacgtacaaaaattatttacaacttctacaaacttttttcacatctctcctctatacttaagatagtaacaagaagaactccaatacttgttaaattaaaaactttttttcataactggccggtgaaagtcacatttcaccggctcctccctttttatgggctaattatttcctggaaatttaggaatgaccgttgcaaagaaagtcgttctattatagaatagggaaggtgcccgtggcatatgcaaacttggaggatattatacatcatgaagaaaaatgcaatcgtaggacaatccggcggaccaaccgctgtgatcaatgcaagcctttacggcgtcatcaaggaaggaattgctcgtgaagaaatcggccgggtttatggcatgatcaacggtatagaaggcttcatgtccgacaattatatggatttgacaggtgatttgacggaggaagaactggagcttctgaaattaacgcctgccgcttatttaggctcctgccgctataaactccctgacgatctgtcttctcccttttatccggctctgtttgaaaaattccggaccatggaaatcggatatttcttttatatcggaggcaatgattccatggatacagtaagcaagctctcccgctacgcctcccatcataacagcgccatccgtttcattggaattcccaaaaccattgacaatgacttgactttaacggatcacactcccggatacggcagtgccgccaaatacgtggctgacaccgtccgtgaaatcgttctggactcttccgtttaccagcagaagtccgtcaccattgtggagctgatgggccgccatgcaggctggctcactgctgccagtgcattggccagaaaattcgagggtgataatcccgtgcttatctaccttcctgaaactgattttgattttgaacggtttgcatcagatgttaaaattgctcttaaaaaaaacaactcggttattatctgtatctcagaaggtctctccgacgcccagggcaaattcatatgcgaatactcggatgaagtccgtctggatacctttggtcataaaatgctcaccggaagcggcaaaatgctggaaaattttgtgcgcgaccgtttcggcgtaaaggtccgttccattgagctgaatgttagccagcgctgcagcggcatgctggcttccgcaaccgacatagaagaatccgtacaggcaggctcagaaggggtaaaggccgctttaaacggcattaccggaagaatggtcgccttttgccgtacaggaaactccccttattccatggaatgcaccacggttgatgtaaaccaggtttgcaatcaggaaaagctgtttccttcccaatggatctgcagcaacggcactgatgtcacctcagattttctggaatatgtcctgcccctgatccagggggaacttcaacgaaaaatagaaagcggcagacctgtatatctttaccggagatgataatgtccgctgaactcacaaaggggcgcagacagatatttacctggctgtgcccctttcagactgttgacaaacagtattccggcgttttctttgtgctcataatgactatcttagctttttactaaaatatagatttaagtaatcatcgttacaataagtttcatggggttctgctattttatctttataccagacacctttcccatcaggtaaataaccgcgcttatgatacattctctgagcgctgccatatccactatgtaggcctacaccaaggtaaactgtatccgcatattttgaagcaattttttcagccgtatccattagtttagaaccgattccacaacaacggtatttttctaacacaccaaagtcaacaatttcacaatatcccatatttgcaaaagaaccccaggaagaattgatatacacatttatatatccggcgacattgcctttgtattctgcaacaagagaaatagctttaccagcggtgtcatccgctaacctggtcaaatacttttcttcgttagcctgccatccttgtgccatttcttcttcacaaatagtttttgtatctgtttcaataattgttcttattagaacctcctcatcaaagtaatagaccatatctgcacctcccattatataaataatcgacatttaaagactgacaaaaaattccgatttgacttaattatatcagaacgaaggccaaaaatatatcaatgtttatttatacttttcatattcattgccgcaaaatataatttgactttgtctataatctgaaagcagcacagacggttatttacccggctgaaccacttttatttatgaaatcaatatttttgatcttatatttactaatgtctaccaaattcattttttttgtgcattttttgacagcatgccacatatattcataataaagcctatttctattttcataagcacttatgggggaaagtgaacaatgaacgaagaaccttttttagatcgcatcccttgcggcatactaaagcttaaaaccgatgaagaccttaccattctttattccaatcaggctataaaggacttatttcaagcgcctgcttctcttaaggacatggtatgtgaatcagaatttccggagctgctggaagaaatacgcagccactttacagaccagccagtcagctttgatttggaattcaaagcaaaaatacaaaaaaactgcgtctggtgttccttacaactgaattatatccctgaggaggaattattgtactgtgctatctctgatatcacatgtatgaaaaaattccaggaacacttaaggatccgggaagaacaataccggctggccagccagcattccggctgccttgtaagcatctacgatattccttccagaaccctttccccctcacctgaattttccagaaccttccccttcccctacaccatgccgctctccccggaatttcttattgaaaacggcattgtacataaggaaagtgttactgattttctggatttttatgatgacatggaaaagggtgtacctgagggaaaatgcatcacacgactgaaaacaggatcaggagattatcactggttctccactcattactcactggtgtgtactgaagatcagcgccctctcagaggtatcatatcttaccaggatattacggatcagtatgaaaaggaactggcttaccaaaagtggatggagtacatgcgggaacagaaaaaagactgtatcggttattacgaatataacttaaaattcgacttatttgaagaaatcattggagaaatgacccagactatgccggaatatgtcaccaactccttttccagcattatgaactacattgcagagcattatatttttgaagaggaccgggagatgtatctaaaattcttcaataagaatcagctgctctatcactattatcgcggcaaccggtccttacggctggagcaccggcgtttgcggcccgacggaagcgtttactggggcttgggctggtgcagatcgtttccgatccatataccgataccattaaggcttttatcctcattaaggacattgacgcagccaaacgggaggccctgactcttcaggagctttccaaacaggattccctgaccgggctgttaaacagggcaacagccatacatgccatacgcagcacattaaaagacagccaaagccatcacatccttatcatgctggatattgaccgcttcaagcagctgaatgataattacggtcatcattttggggataaagcgctccaccgcgctgcttcaaggcttaaatccgccctaaggcgggatgacatctttggacgactgggaggcgatgaatttatcattttattaaaagatgtggcctacagtatggatttatatgcccgcctggaaaatttatgcagcctcataggcagcgccctggaaccggaagcacatatttctgccagtttaggaacagccgcctatccggaagacggaactgtatttgaagaattatatcaaaaagctgatattgctctttatcatgcaaagaaacatggccgcagccaatatgcggtttatgaacctggcatgagcatgacaaaatgaaaaagaggtcctatactgaatgttggggtgtgcttgaaaagcattcttccaacattctttttgatgtaataaaatatctgtgtatcctcgtggatcccagagcttacgcttatctgcacttaataaaaaacatataacttgacatactattgtcaggttatatgttttataatttacctgaggtgatgatatgcaaattaacaggctttttgaaatcgtatatattctgcttagcaaaaaaatagtcacggccaaggaactggcggaacgttttgaagtgtctgaaagaacggtttatcgggatattgatacgctctcctccgcaggaatacctatttatgcaacccagggaaaaggcggaggaatatcactgctggaccattttattctcaataagtccgttctttcagaaaatgaacaaaacgaaatattgtttgcactgcaaagcttaaccgtaatgcagaatccggaaacagacaaggtgctttcaaaattaagcagcttgtttcaaaaaaacaacatcaattggattgaggtggatttatcgccctggggcagcaataaaagcaaaacatgtgaattcacgatactcaaaaatgccatcctgaatcatcaggtcattatgttttactattttaatacagccggagaaaaaagcagccgaagggtcgaacctgttaagcttatgtacaaggtgaatgcatggtatctgcaaggcttctgccttacaagaaatgaatacagaacctttaaaatctcgcgtatgtccaatgtggaaatgtcaccggaaatttttgtaaataggccacaggaaaaattgttggaagatcaaacggaggagagttctaaaatatggattgatgtgcagcttcagattgctccagaaggtgcttaccgggtatttgatgaattcgatgaaaaggaaatcactaaaaatcgggacggctcctttacagttacggcttccttaccggaaagcgattggctgtttcactatatcctctcttttggaacctatgctgaagtcctcgccccgcagaacatacgtgaaaagatccaaagtaaattggatgagattctctggaaatataaaagaaataaatgatatcttgacgcgacgtcgtcaggttatagccggtataattcaaatacaatggttaatcaccctgccaatcatgaaaggaggaaattagcagacccttatggattcccttggcgggattcccatcggacggacagcccggccggaggaaatcgctgagcttgccgctttcctggtatatgaccggacatcctatattgtcggggccgaacatacaattgacggggtattatccgcacaatttaagcaatttataagaaggagaacaaatatgaacatcaaattaccgcagtctattgaaacatatttccaggcgtcaaactcgtatgacagcagtttgcttgccaagtgctttgccggagatgccgtactctacgatgatggcatgatttatcacggtcccgacgcgattaaggagcatattgagaaggcaaacaacaatttgtcagtcaaaactgaggttacaaatgccgtagaaaataataggaagtttattgtcaccgccacacttaccgggaactttgagggaagcccggttgcgcttgactattatttcaccttaaaaaatcagaagattgttgagcttaaaatcttattggccggtgactgaggaaagttcaaacggcatacctcacgtttcatattgctgacttcatcgtttccgtaatgcatgtaatcactcatttttcctcaatggaggatatggaggcttatctcgtccatcctgtacatgtagaagtttcaaaatatatagcggaggtactcgaatcgggcgcatccgtatgctatgaatctgccatttcaatgcaggcatcagctgtcaaattctcggtatagaaaaaatgtcctgtggtattttccacaggacatttcagcataactatgcagaagaagggacttgaaccctcaaggtattgctaccacacggacctgaaccgtgcgcgtctgccaattccgccacttctgctttttaattgtgcaaattaacaaatcaatttgcacaattatagtactacattttcgtcaaataatcaagtacttttttataaatatcctcatcttcagcaatctttcaacgctgatgtcaaaagctgcatcaaaaaagccaccttaatattccttgttttaataactgtctccgcatcagactgatcgtacaccttttcttctgttataatccgaagaggcatttcctttcctgcgatcatatcccggattgctttcataaggggaggccccagaagcggactgcattccaccgcacagttcagtttgccgtctatcatcgcctgaaacgcttctttcgtcgcatccacagaaacaattgttatatccttccccggatttaatccatgggcctccaaggcttcgatcgccccaagggccatgtcatcattgtgagaaaagataatgtccacatcccagttgtggctgctgatgtattcctcaacaacctgtttccctccgtcgtaagtgaaatcaccataatccgtatatacgatctggtactggggattctcctccaatatttcaaaaaatcctttttttctctcttccgtcggtgtggctccttcacttccctgaagctctaaaatatggacaggtccctgctccggttttacatgttctttcagccagcgcatggctctccgcccttcctctaaaaagtcagcaccaatataagtggttgtcagatcatctcctgcttcgattctgcggtcagacattactacagggatattggcctccttagcctcttttaagacctcatcccagccggtctccactactggagaaaccacgactacatccaccctctccttaataaacctgcgaatcgcctcaatctgcttcttttgagactgatctgcgctgtcaaaaagaagttccacattaaattccttggcagcctcctgaatggagcgggtattggcaagcctccactgactctcctgtcccacctgggaatatcctacggtaattctcctgccatcgtcaatactttgtcggtcaagagccgccagatactcaccggcattttgaggatagatcgtatggcttcttaaaattacctgcttgggaactccgctttccttccgaagaatattaatagcatattgtactgcctcttttcctcctgttgggcaggaaatcgttgctgcaagttttcctttccgcaccaaatccaccccttcattttctcctgtaaagccgtcacaaccgataaccttgattttctcagccagactcctgtcctttagcgcctcgtatgctccaaaggccacggaatcattgttggcaaatatgagggaaacgcctttcagttccttctccatggcaaaaaccgcatcataggctgggtccttcatgtcatttttcagatcacagacagtcttttcgatatcaggataatccctgatcacagaatcaaagccctcgctccgctcctcgctctgaagggacccggcagtcgcacgaagttccagaattttcgccttcccatttcccagcagccggaccgcacattctccccctgcttgccgatgagattattatccgggccgataaacaggttatagtcaaagccctctacgcttcggtccataacaattacaggaactccctcctgatatacctcccccaccttctttgtcagacggctggaatcacagggggatatgatcaaaagatcaatgccgaagtccagaagcctgtcaacatccttttcctgcttttccacgctggaggtcgcatctgccgtaacgattctgatattgggatactttcccgcttcctcctggatctcatgtatcaatgcgatccgccatgcttctctcatgtttgcctgagaaacgccgatcacatattccacatcgcttttatagaccgtttgggtaattgccccgttataaatccggtatcccaggaaaccaaataccatgatcagtaatatcgccagtaatttcgttcttttttccattttaccctttttcaagatcattctgaacttctttcggaatccgtataacaatactcgtcccctgcccctctttgctttccaccaatacctggaactgctctccgtaccggatgcgcagccgctccttaatataaaacaatccaaagcttctgtttctgccggcttctcccggctcatttaacaatctggatagctcccagaccttttcttcctccatgccctttccgtcatcccagacctccaggctcacccaattgtcttccacccttccggtgacctttacatgcccatccccgctcttcatcttgaccccgtggtaaatggaattttccaccaggggctggaggatcattttgggcagaaccaccttcatgcagtcctcatctactaaaatttcgtactgtaccttaggcccgtaacggattttctgtatgtagagataattggaaatgtaacggatttcttcttctatggtaatatagtcttttcccttgctcaagctgatgcggaaaacattggtaagggcatctacaagatgaacaatatcataagcggaatgttctctcgccatccagccaatggtgtccagggtattgtataaaaaatggggtttaaactgctcctgaactgcctttagctgtgctttccgcttattctcctgttccttatatacctcctccatcaattcctgtatccgctccagcatctggttgaaccggcggccaagctcgcttacctcatctaaatagttgccttcaaaccggacggataagttgcctttttccgtctctttcattaagttgcgaagcctgacaatgggctttgtcactgtctccgaaatttttaccgccacaataaatacggtgagaatcgttaagaccaggacccagccaaacatgaacagcatggtattgattccgcccatgatttcccggtaggatgaaacactgacagttttccagccggtataggctgatctttgatagctgatctgatatttttccccattgatcaccgctgtcacaggctcttcttcattccacagccattcaggacggatgcggtagacgattttattggttggtgcatacaccaggtgattctgctcatccaggacgaatacaaatccattttcaccgatgttcgcatcctgaatggcggaagaaatgatctcatgctttacatcaaacagcaatacgccgattctctcccctgtttccgggtcaatgactgctttcatcactgaaaatacatcgtcaatgctataggctgcctccgtaacaatatttcttccggtaacatcgctgattatctgcatttcaccgggaaatgatgctgctttttcataccagacctctttgacaaaggggtcccgggagattctggacatccctgttcccacatacatgtcatgctccgtagcaaaaaatatgcctgcgatttcatcatgagtatctgccactgtctcaaagctgtctttcagggctgcttcatactctttccagcggccgtcctcagcggaggggatcctgccaaggtgcattggttcaatgatccggatgagcatattggctgtcttttcaatgctgcttatataaatatccgtggtatgctgcacctgtcccaccagcaaagacgtatgctgggtcacgttgcgctccgcctctctggttgaactgataatccccaaaatccccacaaaacagaagggaatgagcgcaataaaaatatgagaattgatcattttatcacggattttcatatccatgaatcgtttcttccaatatttcattgctctcactcctattttcatatcatataacctgcctatccagtataccgaagttaacagcttcttacaaccgtattatttgccttattgcccattcttcccctttgatttttctgcacggattgcaatgaccctctgaattacaatgaagaagcagagaagcgcagcaatggtaaccttggtccaccaggtatttaaattctgatatgtaacgattgtctggataattccctctatcataacgcccacaaccgtacccgccacagtgcccacgccccccgtaagcagggttccgccgatcactgctgaggaaagcgcatccagttccaggcccagattttgaagtccgaatcctgccagagtataaaagctgaacacgattcctccgagagcagcgcaaaaactgctgatcccgtatgccgcaattttcgttctggctacatttaatcccatgaggctggcagacgtttcaccgcctcccagggcatataaacaccttccaaactttgtatatctcagggtatagactgcagctgcaaaaacaatcacaaggataaatacgtaataataaatcttcccgttccacgcttttgcttcccccagccgaaccgttacctttccaagagccatggtcttaaaaaacggatcgctgatgggaatggaacgttcactgatcacaacacagagcccgcgcatcaaaaactgacccgccaaagtcacgataaacggctggagcttaaaatagtggatcaaagccccctgggtacagcctacgataattcctgcaaggagcatcagaataattaccagaaacgccggaactccccgttccagtaagtaagcggagccaacacctgtaaatgcgatggtggaggcaatggaaatatcgattcccccgcttatgagcacaaaagtcgccccaattgccgctatcatcaggtatgcattgtcattaaagaggtttaaaaaggttgataaagataaaaagttattgtactttacagaaccaaacagaaacatcaggacaaacagcacaacggtgataaccagcgaaatattattgatgtgtaacctttttctttttcccgtttgctccatcagctgccaaccacctttctgtttatcattttacgcttgatgaccagatccttaaactgctttgactgggacagacagatgataataatcagcaatgcctttaacacccggatataggcggccggaacacccaacgccagtacggttgtggtgatgctctgtacgatcagtgcccctatcacgctggccggaatggaaaaacgcccgcccattaagttggttcctccgattgctacggcaagaatggcatccatttcaattcccagcccggcattgttgcagtccgcccccttgatccccgcgctttcaatcaagcctgccacagcggcaaaggctccggaaagcgtataaatggcaaagagcatccggtcaaccttaatgcccacatacttagaggcagttggattgcagccaacagattccaaaaacaggccaaatgccgtccttcccgtaaatatcaccaaaagccccaccagaagaaccacaagaaacaagggaaagggcaatccgaaaacatagccgccattgataaaataataggcatcagaggtgatcgtaacgatctttcccctggtgatcagctgggcgattccccgccctgccaccattaagatcatggtagccacaatcggctgaatctttatctttgctactaaaaaaccattccagattccgctggcaatgcctgcaaggattgcgacaatgatcgctgcggcaacatttccgtttaaatccgggaaaatgttcccgtttacgatgctgcaggcaatggctccgctgatggccatgatggagccaacggaaatatcggttcctcctgttgccagtatcatggtcatgcccgctgccagtatcatgagcttgcttccatttcttacgatatcaatgatacgtccgtataaatgcccatccacaatggacagggtgtaaaattctcccttgctgacaataccgttaaatagaagaatcatgataaaaatgaccagcgggcggaaatactgctttcctgataaacgattccaggtttctctcatgatgcttcacctccagccataatccgcataatcgcttcttctgatatttctttcccctttaactctcctacctgcttcatatcccggagcacgatcatcctggtgcagcagcggagcatctcgtcaatctctgatgagataaagagcacagccatcccttttcccgcaagatccatgacgattttctgaatctcggcctttgttccgatatcaattcccctggttggttcgtccagcattaaaaactccggttcaatggcaagccacctggcgagaatcaccttctgctggtttccgccgcttaaattcttaatcagctgctctgttcccggtgttttgatctgaagcttttcaatatattcctttgccagctcttccgcttcttttctgggaatcttatggaaaattcccttttttacctgaagggcaaggatcacattttcccagatggaaagttctccgataattccttctgtctttcggttttccgggcagaaagcaattccacttcttatcgcatccaagggtgaatgaagggaaaccgtttcactttttacatttacttccccttcgtttataggatctatcccaaataaaaccttggctgtttccgaccgcccggaacctaaaagcccggaaaatcccagaacttctccctttcttacctccagcccgaatcccttaacagtgccggggctgctgacattgaccagttcaataaaggattccttctcctgttcctttgcttcctccggccgttttgcgctcatggattccttaagtcccgcgtaatccttgcctatcatttttcccaccagctctactctgggcagctcttttgtcaaataggttcccacgtattttccgttccgcagcacggtgatcctgtcagtgatctcataaacctgatccagaaaatgtgtgacaaaaatgattcccatgccctcccccggagctttctcatgatttggaacagcttttccacctcagcggaggaaaggctgctggtgggttcatctaaaatcagaacctttgcatcaatatcgcttgcccttgcaatggccaccatctgctggattgccacagagtaatgatccagattttttgtaacatttatgtgtaaatcaaatttctccagcagttcactggcatcggcattgatttttttccaattaattgttccaaaccggtttcttggttcccgcccaatgtaaatattttccgcaacggaaagattgggacaaagattgacctcctggtataccgttgaaattccctggttttgcgcttcctgtgtggatctgggattgatctgtttcccttccagctcaatgaccccatgatccttggcttccactcctgtcagcactttaatgagagttgactttcctgcaccgttttcccctaacagggcatgtatttctccccggttcaaatcaaactgtacatcagataaagcaatgaccgctttcccaaaggccttggatatatttctcgctgtcaacagctggttcccagcactcatggtgtttcctcctcgctttcaaattaagagggcatctcctctgatataaaaagggctgctgcaaaaataatgatttacttttgcaacaaccccgcggtttaatatttgcggtccggaagtaccttagctgccatatcagcagtaaatacgccgtctaccgattttacccatttatcaacagactggcctgctttcagctttgccgccgtttcaaataaaagcggcccaagcagaggattacactctacggtacagtttgcctctccggctgccattgcctcaaagattccacggacaccgtcgatggaaacgatcttaatgtcttcgcccggctttaatcctgcctctttgattgcctcgattgctccaagtgccatatcgtcgttgtgtgcgtaaacacccttaatatccttattggattttaagaaagactccataacctcttttccctgagccctggtgaaatcaccggtctgggaagctacgatctcaatacccggatagcttgctttgatttcatcgtcaaatccggttttacggtcagttgctgcggaagcacctacggttccttccagctcaacaatctttccctgttctccaagcagctttgccatttcctttgcagccatcttgccttcttcaatgaagtcagaaccgataaaggttgcatataagtcttcgctgacatccgctctccggtccagaagaatgatcggaatccctgcttcttttgcctcggcaaatacctggtcccagcccgtttctacgacaggggcaaggccaatgacatccacaccctgctcaatgaagttcttgatggctttaatctgattttcctgcttctgctgggcatcggcaaaaagaagctccaccttatccccgttttcagacgcataggtctgaatggaaagggtttccgcgtcacgccatccggactcctgaccgatctgggcaaaaccaactaccagcttttctcctgctgcgtcgggagcttttgctgtggtttcttctgcctttgccgtggtctcagccggggcctccgtagtctggggagcggctgtggtcgcggtagagctgctggctccgctgctgcaggctgctaaggaaaccgctgccatggaagcacacagaagaacgcttaaaaatctttttttcattttgatgatcctcctttttttgtttaacgatacatttattatgccggaaggaggaactaaagtctttgcaataatttgagtaaaaggtataaaatcattgcatgggggaggtttggttatcatttttaatcagcctgcggtattctgcagggctgacccctaaattctttttaaacacattgctgaaataatgctggtttgcatacccggtcagttctgcaatttcgtagatcttcatttctccgttatgtaaaagctcaatggccttgcggatcctgacgctggttaaataatcgataaaggtgactcccatctctttgcggaacatcctgcttaaatggggaacagaaagattcacgtggccagctgcatcctgaaaggaaaaatcctcccgtgaatagttgtcctcaatatagagcttcacatcctttatcacagaagaaccggtttccagctcctttaagcggctgactgccgtttcataggtttcagccaaagctccataatcatctccgtttacctgaattaccaagctgcgcaccggcagatgggactccagcatattgcaataagtctccacctgctcctctgcaatttcctgggcagcagtctttgagatcaccaccagatttccatgccggtcctggcagctgcagggattttcaagtccgtgaaacatttcatttgcaatattttcagcaacaaaaaaaagtaaatcttcattccaggtgcttttgacgtcttccattttcaaatattccagagaaacaaccgtgacagtaaagggttccggaagtgataagcttaagtactgggaacgttccctgatctcttctctggtataatgcccttccagagccttttgccaaaagttggaagcaagataggtacggttttgcgcaagcatactcctggcccaatccagatatttatcttcgctttcctccctctgcagtctttcccggacccgcttcatcatctcatcaaaagggccctccatcaaaggcttgagaagatactcaaaaacccccagtttcagagcttctctggcatattcaaaccggtcatatccggtaatgatcacgactacagccctggggtttatatcccttaaattttttatgaattggaggccatttaaaaatggcatgttgatatcaacaaaataaacatccggagaaatgctttttgccagttcaagcgccatctctccatcctcggcttctgctgccagctcgaaatcgccgtattgccgcaaaaaactgataatccccctgcgaatgatatattcatcatctgccaccagtactttataccccataggtacccctcctgaaatattatttgttcctattatagcacattttttccgttgtaactgtatttatgcaggatagggaaatggagggtaaggctttctgccttatcctccattgttccgttctatcccgtgatgggatttaaattatgccttggaaaaatcatatggaatttacacttttattatttggctaacattgtctttgttctcagctttgtaacaactttttccaccccaatttccacctttctggttttaattaaagattatatatacaaaaaagcaaagccaaaagacaacaaggatacaggccgattggctgcatctttatggtttactgcatttttcgggcaactaccgctaatcttccgttatccgttgagtattcacaagttgacaatatgatcagttcatcgccatattctgcagaaacgcctgtatcataaagagcaagcttcttaatattgctgatataggaatcgtattcatcaggtgtttcaatcttctcaaattgatagtatttaaaaacatcctcagatttaaggtgaaccttagaaagaataactgcaacaatctcatattccgatgtttcataaagcgtgtcaaacctgaaagtaggatgatcctgataaaaactttcctttttataccgtgtcaattctccgaaaataaggccgcttttcatattatgtccatgaatcagtaaaatgtctgatccctgtattctgcaacgcccatccaaaaaaggaagaccatttttattttcttttttgtcgaaaccatgactgaggtaatattcttcctcctgccggttctgcatgacaggataatcgatctgggtgccatcaattttcagccatccaaccatatccggatttttttcatatagttcctcataagctggaaggatggctgtttcatgctgctctttggaacggtcatctggcattgattccaagctggcttttgctgtctccctgttcccagtcaactgagtcaattccttctgctggatttttaagtgataatcttccagcagactgctcccaatcccggacaatgagcaggttaaaataagaagggaaaagacaataaggaattttctctttatattcatgtttcttaccgcctttccacttttactttagttgtattgcctgatcatcaataatccctttaaagtatactttaaaaaatgccttcgttaaaatccgggcactgaatgatagcttttatgtattaaattttcttccttttgaagaacgaatttggttcctaatgttggtgcaaaaacatagcgcaaataatttataaaaccccattgactctcacattatggtatactatatcatatagttgagctcaaaaaacacatatatgtgaggaaaccaaaatgctgaaaataggtgatttttcaaaactttcaaggatcagtatacggatgctgcggcattacgatgacattggcctgctggtaccgaaaaccacagataactttacaggctaccgctactacggcgaggatcagctgcctgttgcgggcagaatcacagcacttaaggatatggggttcagtctcgcggctatcggggaaatcttaaagagctatgataacccgcagaagctggctgattttctggcggtgaagcaggctgaggtacaggcagaagccgaagaaacaggccgccgtttactgctccttgatacagccattaaacggctgagaaaggatgatacggctatgaattacaatgttacattaaagaatttaccggaacgctacgttgccagtgtacgaaaggtaatcccttcctacaatcaggaaggaatcctgtggaaccttatgatgacggagacagctcctctatcgttacagcctgccgacaattgctgcagcctcgctatttttcatgatgagggctacaaggaaagcgatgtggatgtggaaatacaaatcacggtaaaaggcagctatcatgatacggaacacgttgtatttaaaaccgcacctgcagtggagattgcctcggcaacctacaaaggcagctatgagcagctcaccgcagtaaacaatgcagtggctaattgggtgaatgacaatggttatgaatttaacggggcaatgttctgtatttatcatgtcagccctgctcaaacacagaatcccgacgaattagtaaccgaggtttgctgtccagttaaaaagaaataatgattacagatgtaaaaaccgcttacaatttgcaggcggtttttgcagtcttacaaacattttttcaccaatccatttggtttacacgaaataaattacacgttcaattaaacaccatttattattctaaatcctgcatacttatttttccttttttttatgacatccaaaatatatagttaagagagttatggttgggatattcgttattaaaaaagtagacataattaaattgaaattattccatacggttataccgtcagatttggcaacggagaaccccatacataatgaataggcaaaagaaataaacggtaatattaagcccagccacttgcttactttttttgagagaaacacctgtaaccacattgcagcagccaagattagtactacagtgaatgaatgaatcgctattctcatttattcgctctcctttttgagtttcttctattcgtacattaaaagatcagccatatcaaatatattttttctattacaacttccccattgaccaagacaatgtccggctcgtttttatatcctcacttatttggacttccagggataagcctgtcatttgaccgtcaataaaacacttgcatcaatttccgtaattttttccatgttctccgggtcatatatcatgaatacggcagttgttctatgcacccctgtttctggtacctgtcccagatctacataagcattccgttctcccggtttcagaatttctgagcaaaacaattcttccccgtatcatccagaatcaatttcacctttgcatactgctcattttctgccggatttccaatcatcagattacagcgactgcctgcccttgataccgtcggaccagcgtttacctgaacggtaaaataagaactttccttttgatccccgccctgccccggttcatgggtcgggcgtacatattctccatcctttgcttcctctgcaaatggatacgctctctccttgctgccatactgaatacagacggcaatgaacagcacagcaatggcaatcatcgcaccggccaatatggttttcatatttttactcaatgatttcaatgctctcaatcaccacatctttctttggctttcgttcttcggctgatacctttacctgggtaattgcctctgccacattcagcccttcgacaatctgaccaaataccgtatgcccataatccagtccccaggcaccaccgacctggcggtatctcgctcccacaggtgcatacttagcttcatattcgcttggtatcccatcggttgcaatggcctgaatttccccatttaaatcgtcctcaaatttttgaatttcctcttcactcatcggtttttccttaccaagctcttctaagtctttcagacgcatattcatcaaatcattcatatagcagttagccgggacaatccggtcatcttccggggtgtcctcccttataagaagataaaactggctcaaattactgttgcgggtaatgcctccgtcaccggccattgcaaccgcacctttaaaatgatacagcccattgtcagtctcatcttcaaatggatcccccaaaggcttctttcctctgcttccggatctcccggttttccgccttgggtcagttcaccccgttttgcgtaatggaacaagctgccgttgtagtaaccttcttttgccagaccgataaaattctctactgctttgggagcctgctgtggatacagtagaatggtaacatctccagccgtagtatggagaattgcgtaaggtccatgggattctgctaattgtggattctctgccggttctgcctgaataggaaaattgtctgcaatatccggagatacttctgcataactctgtttctttacgcagccggtgaccagcaaaacagccaggcataccagtggaattatcttactcttatttgtcataccgttcttcctccatatcacttaaaattccatatactacatatctggcatcgttatattcataggaacaggtacaaagtgccagtattctttcattttctcctactgcaaccggactttcaaatgtggaagaatccaaaagcttttttaaccacctctcccgtgcatctgcatgtttaaatacaatcggaaatgttcctttctggccatccagtatctctccggcaaataagtctacccgataatccttatcaggagtatacaaatacagaactggatgctcctcataataactttgtgtcttatacccggaaagggaggagaacatccgccctcctctgatgtgatgcccatacagaacagtcacatcatcctgaaactctttccggttttggctatccatgaaaatggaaccaatgatacttctcacaccatcagcagtatgattcagataataatcattatctcccccctgtactaccggataatcaatatcggattccggcaaccagatccatcctgtaatatctggattccattgcagcaatgtctcaaaatccggccttttccttgtacgtgtatctacggttctaatatccttatcaccatcaacggaagctccgaatgccatcactcttatctggccatatgcctgctcggcacaaaccctggggttcatctcctgataaaaattccagccgcaaaaaacaactccagccaaacataataaggacagtccacgaaatagtaatcgtttattcttcatccacatatcctaattgagtacaagaacctgaatctttacctgaacctgtccgatatcctccaaagactccggatcggtcgctattacctgggcagtacaatcgtagtttccgggcggaaggttttgttttaactttatcttatcaatatactgtcccggttttagaccctgactctcatacaacacttcatttgtatcatctcttcgaattactacacggcagtaataacggttttccggaatattctccagaccaatagaaccttcactttttgcatcgttaaaaatagctttggcattcatggatacgttaaacatgccttcttccacaacggaattcagaatcccctgaacttctgtcggtgtttttccctgcaaagaaccatcctgagccaacttgtcaaaccagtatttggttgtcgcatccatcacctgattctgtgtataccaccaatatccaccacctgcagcgataaacaacagcaggatcagaagaagggcttttttcttgcccttcctccctcctctattattgcttatactgccagatgcagggtctttttcagagactttctcttgtgtaatttgtgtttcgttcatttcttccaacgctaaaaccctctctttcgactgtgttaaggagaccttcttggcggaacaatctctaccttatatttcatcagatattttgctctggcattgactgcaccggagttagaagttccgtccatgtattcttgtacttcagccttggtagatccttcaatcgggaaggaggcatccatatacttatccacaaacccattacctacggctcctacaaaggtaaagttaccggacgtttgcgttttcaaagttcccagtacaatcggtgctgcagtgaccgtagcttctgcataaggctgcagcgaagtctccgggatatcaaatcccgtgccgccgcttgcatcatctaaaccttttacggccaggtacaaatcattctcagctgttgttacagccgcactggcggtcagattcatcagataagacgggtcagctgtaatccctgtctccatcgtcttattttcaaatccggtaatggatactttcgcgtcatagattcccttgttttttatcatatactccggtgcggtaaacagatcagtgactgcagaagaatcattaacactcattaatttgttcgtactgtcataagaacctctccgacgtacgaccaggtaaatgtcagccggtacttcaacctttaaaatttcccagtcctgcaattcaagaacatccggatcgctttcagcttctaccaggaataagttctctgataccgtacttcccaaatggaaatgttcatgctccgcgtccgcattgggatgataagccgaactgctggtaaaccgcaccacatctctgccttttactccatgatccatatcaatgtcgaaaatctgattcgccggtattgctattgccgtctgaatcacgtggtcagttccccagacaggattttcttccgttccggtattcacagaggtcaggtaaaatgtattctgatgaccatccagtttttccggagcacttacgatcataaaagtaccgtcctgatatactacagaccctttcgcggccttgttgttctcaaagagagtactatcaaccgtcgtcgtgccgctgtttaagatggcaccgccatgctggccattaagatctgtttccagatcataagtattgttattattataaagggttacattcgacagaagattcaaagctccgcctttttcaacagttatcagcggggcctttgcctcaccgttacggcttacaaccgcaccgaccggaagatcagtactggtcttcggttcactgtgtccgtcaaagtatacgtttgcactgaactgggcagttgcaccatccttgacattcagcaatgcaccggtaaaatcctccacatcatattccgctgttgctgcggccgccggatcatcaattgcaaaatccggctgtatatatcggacaatgttaatcttattggtactgcccagcataacagctccacctgtgccgatataagactgtcccgtcatttggatatcactgtttacctggatggtaccgactacataaacagtatttccaccccgggtttttaataactcaaaagctcttgccaacgtttttacaggaaacttcggagtcgaaccggcaaaccggtctccctggtcgtcaataccgtttgttccgtcaatataaacggctaccggcacctgcagctccaggatattcggatatccgctgcggtttgacagacagaagaaatcctttacccgctcttccagcaggaaataaccggcatcattggctgttgcattgattcccgcctgataatgaaccatatctcttcccatatacggatctctcaccataacatggaaattattttgtattggagtaccatacacatctacagtcagataacggctggtatcatggtttgcatctttggttccgaatccctccaggaacacacttccgccaaagttcgtataacggctgaaatgcaggtttccattgctgtatacatctgtacctccggaaatcacatgatcgtctaatgaaaggttggaaaattccgtatattcaagaatacaggtaccatcatctaaaagctcaatacccgcgctgctgccttccataatatcagaatcattcagatggccgacgatgtattccggtccatttttgtttttttcattaaaattgttaataaatagtgttgcggtaggaacgccattgctcacgccctccgcacggtaacattgcagtacaccgcttccttttacggtaatcagcggggcctgagccactacagccggtgccactaaggttggattaatgctgtcactgctgatcgaatgtccatccagataaataccgcttaaagtcagtttaccgccattgccgatatagaataaactgtcaagcaatgtttcgttgctaaatccatcataaacaggatcagcagcagcataccccttgggctgggaatatcgtttgaaatatacctgcccccggatattaacagtctcacccggatccttataatatccttcataatgggaggttccgtcactattgtaaaccttaatattcattagctgaatatcagatggttcactggttccccagtgatgtccaaagtatccacaatataaatcagaacaccattggtacctgcctgatttccaatcgcctcaaaggtacgttttaatgtcttaaacgccttttccggagttgttccgtcattccccgtgtcatctgacccattctgaccatccagataaattacccttctcagactcaattccagaatggaagcattggaactgttgttcacaatatcatacaatgccttgatcgcatcatcaaaagaataatatttcagctctgtctcacccggcacggcaccgtctttatatctgatcaacggacggccattataatcattgctgacagaaatctgtaatgctgatgaaggaatataagcagcatccggctgtatatacgccgaagtaacattagccgtaccatttaaatatacttttccggatatgaccggcgaaccggtcagatacaactgtccgagggatgatggatcgctttcacttgcattgagataaattgcacttccataagttgcattattaccttttatctctccgccattgattgtcaggattccccgttcggctacttggaaggcaccgccctttgaacttaagttatccacaaatccatcttcggcaatatagttgccgatgttgttgttatttgaaaagactgcgccgctttctaccgttacattgatcctgtaagaatattcacaatactgtcaccattgtttaccgtactgtctgtacttctgcgtccctgaatcgcgatatctttcaatgtcaggttatagtccggctgaatcaagcagccgtaatatgcccgctcaagctccggtgtttcaattccatcgctttcataaacctggaatccggtatagcggcacatataagcagtttccggtaatgtccagacactttcactgcttgtattaatcgccttgccgcatatgtaaatcacataatgctccgtcgttccatgagtcgttaatacccccacactcttggccttggtaaagctttttacggcctggctcggttttaaacctgtatttgtatctttcccgtttaccgaatcaagataaactgccttcatcagaattaagcattgttcttcctttaccccgctcacgtttccggcaaggttactggttcttccctgatccagtacatacggatttgaacgtacatcaaaatatgagagataggaaccgacgtttgttaccttattgccatccggctctacaactacactgccttttctaaagtagctgattccctgatttaagtatatatgataggaacgtccggtctgataaatatgatcacttattttaatggcacttaaggtttggtataaataaatactgtcacggatatccgcaccgccgccgctcagttcgaaccccttctgcatgacaaaaattggcgagtacttattgatagactgctgtccggttgcatttgtcgtatttccgctgatctgcccgccggagaatatcagttgggaagaactgttaatgccctgatggaaaattgcactgccgcatcctccttcatttccgcggataattccgccgctgatagttacagcaccatcataatttacaattgcacctgctgctcccggatttgtatttcttgaaacaatcttgttattctcgatcaggccgcccctcatctccataccgctgggagcagaaacagtgctgtgtatataaatcgttccgatacgtgcactggtaccttgtgcatttggagcatttagttcattatttattatctgccccgacttcattatcaaatttcccggataagaagtactgaccccctgaaccattaccgcagaggcaaagtagtaactactgaaactacggcttgtttctcttactatattccgaatagttccaccgcttatctcaagtataccgccataaaccttcacacccaatgctgaggtgttgctataggtagtcgttacagccttgttgttctgcaatactgcgccctctccaaggacagcggtccttcctctgccaaccatcagcaattgatcattcacagctgttgtcaatacaataccattggctgagccgccgtctattgtgatatttttaaacgtaacggtagaagcgtaaaccgtactggtgctgtcgtacagcgtaatcaggataccgccatacccttcataacgggttaccagcggctgccatctttgcccgctcagagaattcgttacgaatcctccgggttcaaatgaccagtcttcatcctctgcaagtacattaacggtcgaagtacagataatgatattcgctccggtcgtataataacctccgccctgcagcagttctctggcacgtttaaaggttttgaccgctgtagatggagtgttgccagagttggcatcattcccgctgcctgacagataaacattattttctcccagcagcacaagatttggtgacagctccaccatcggccgcatggctgccattccgtcagcactggccttatggaaatatgccagctggcttcccgcacccgtaagatccgtaatgccaatcatatcaggctgaaccactgtcttaccggcaaagccttccaccagatgcaaatcatactttggcgtctgaccggtcgcagcatgggtcattgtaatcggcttggtactgttgttcatataaatcagacccttaactaagcttcttccatccagttcaatgcatccataattatcaattgcacgtgcaacataagagctcgaggaataaggactgtcactgatttttaccagtgcttccccttaagccgcaagattgcatcagcccctaaatagactgcatctgtatttccctggatagacggtgtggaaaagcctccagcatctttcattccatttaattcaatgatgacttcattgtgatagcttgttgtggagtcgccgatcgttgctgcataaacaccgccgcctttattatcacagatagaggccaaatcatttaaagtaattcttgctgttccggcccggtgataggaggcagatgttgaacgtgtcaggtaaatccctgaacttgctgtgctgccattattaacattggtaccatttccggaaattttagccgttccgttcattgttacctgaaccggaccgttggcatatattccggctccctgatttccggaagcagcatccgtgctgctgtaataatcactgccgccaatcattgcattgtcatttaacgtgatcttttggtacccagtactttctgaccagttgttctgagtatggaccaattgaattcctgagctggagttaccggatattctggagtcaccaaacatttctacgttcacctgtgatgctccataggaagtacttccgttcactgtagcctcggcgatccccatattattctgttcgatcgccgcatggtcttccatccggatgttaatcggactgctgttaacctgataaaagtaaataccataggtggttttgtaaatcctgctgtgatctttcatcagaatattagctgttgatgtggtgctgctgcgtccagtcagatatattccgtctgccccgccagtaatcagagccttctttcccattgaaacagtgctgttctctgccgcccccaggtaaatgccatggctcatatccgtgatcgaaactgattcttcttcggatccgtcagtttccatattcagtaaaatcattacatcttttgcataagaactgtttgtaataatcccgcaggtaagactcataatattgggattaccagtaattctcgaattgtttaacaattcaaccttcggcgatattccgttgtttactgagattccataaaaccaataggatgtgcctgtggccgtactgtcaagtataattgccgcatgatcctgcatctttaccgatgccgttgtcgtacttgagggagacagatagataccataggtcgttgtattgcgttttcctccataagtaatgttggcccggtctgacatcgtaagggaaaaattggccccccgtaaatgccatacgaccaataagcaccttccatcgttgcaatgcttgcatctcctgacatgtcaactgctgaaccactgccggaaatatagatagcaccgctcacggcattgccggtctctaatctggcattctccttcatttgaacggaggtattagcataagtagaataaatcagatagctattcagcagcgtggaacccggtccctgaataatagcactgtttccttctatagatacggagacatccgctcccccatccatataccatagccgttaaagctggcaactttatcaaccgtattatctgtgataatctttgcttctcccagcatcgacagtttggctgaaccatacaaccggaccgtatactgcgactggttattatacagctgcttgttcacttcaccattttcgccgctgagtgttacttctccataaatgtccagtgcactgtagtaattatttctgatcatcgaatctccggtcagcgtcactaaagtacctgctgaaccatagatcacagggctgtaggaactctgatcagcaagaacgacagtatctgccataccatcaattatcagccttccggttgtaaatgccactgtattgctgccattacctactttaatcatcggctgccgcacaaaggaggcgaaccggcgcacctgcggctcatataccggggtcccgttgcgtacttccgctattgcataatattcatttacatctgtatacaacggatcctcataattaagttcccagaattcattggcattaatatccacctgaccgcaaatgtagataaatggtgcaaagccttctctttcttcctccgaaagggtactttcatgaatcgaagtctcgttaatcctattttgtaaaacttcttttgctttatcaaacgttgcaaccgcatcagccggcgaagtccccccattgctgtcatttcccccggttccatcacttttatatcctgctaaatacacgccctggccaacaataatgacattcgttcttgcggtgtaaactgcatctctaaatccgcccagttcacttcttcttggcagctcaccaccgcgaaaatgatctaaattgcccattgcactcaacaatgcaggatatgtccggtttacctgaacccatccggatagatcaggatttggttccagcattgcccgggtcgcagaatttcccaatggtttcagtactacactgccggattgaaacacttcactgtttaaatcaatcggaaaggctgcataagacgtattatcatcttgcggcgctgcaagtactgtcaggaaagagcttcctgaatttaaaaagataacatctggattggctccatctttcttatcagcggtcaccttactgaaatcaaaattcttactgtaggtactggttgatgtatcatcaatatagatattgtacacgccctccacctgttttgatggaaccggctgcttaaaatgtcctttgaaaatatcaatgtatgcataaccgctcaaatagaagttgcttccctgtacagccgcactgttctggatcggaccgtcaatatccatcataaatgagtaaccagttgtaatagcaatcccgccgccatagtccgcatggttatcctttatttcaaattttccgtcttctgattctgacagatacacatatgcactggtacttgacgtgtaaataccgccgccccgattggttgcagtattgtctgtaatggaagagtccttcatataataacgtccgctgctaattgccagtgcagcaccatcccccgcccgattgtcagagatcatcatgttcctgaaataagagtaagaggttgagctggaagaatagatacctccgccctgtgtaaccgcctcattgttgctgatccgtacattctcagcatgccagctgccgccgctatgagtgaccccgccgccataagtaccgtagcttcccgtattggtgattttatttccgctgatttcaattgctcccggagtggtcgccatcatataagtatgggcagacgcggcagaagcaccacctatgtaaagtccgccggtactcactgttgcagagttattaataatcttagttccatcttccagagtaagagtcccatatccatagaagtaaatacctccggtatctccatagctgctggcacgagatgatctcgcttcattttcctctataacggtttcttttaaggttaaagcaatatcctttccggagcttccgtatgcatagattccgccgccgcgtccggctctgttatttgaaaccgttgtatctgttatcgtaagggtattgccgcctgcaagatagattcctccgccctgattataattgtacacatcagagtcagtatagtactcatatcccgtttgattcgtagttattgaacttcccgtgatggtatgactgtttgtaccggcatcaatatagatccctacacctcttacgtagccatatgtcgtaaacgcaccatggttcccattcactaacccggcattcatcgtaagcttaccgtcagcccctacataaattccgactcctaaattaacattcgtataacttttgtatcttccgccagcttcattatcagatatggctgcatgatcaatattcaggctgccattcgcataaataccggtaccataagcaaaatatgatttattgttactgattattgtatcttcctgttccccgttcccatcaccgatgtttacgattgtacctgtatctgcaaatataccgactccttttgaaaacagtacgccgctgtttgtgcctgaaacctgataagtcagtatgctgttacctgtgatcttccccttattcataataaaggaggtccctgcatccacaagataaacaccggcgccatattgataggtctgatttccggtaatggaaccgccgttcatggtaaaccgggcaccaccacttaaaaccacaccacctccggccttatggtcagtaattccggcagtataataatccgtacgataagagttattcttctgaataaaaccattgttcatctcaaccgtggtaccgattccggaagcaaccacaccttgttcccggttctcaatcgaaccggtccagcccgcttccatcacaaagcggctgcctccggtaaccgttacgtggttacccagggtgagatccttctggtcaaactctgtactgttcagccgtgttccgttcagagtggtatttccccttaagttcagcgttccacctgcttctacgttaaccgtaacgctgtcagtgtcatccaccatattacgtataaatacgtctcgtatgctcaaaacaccgcttcctgttactttgatcaaagtttttggaacttcgtgacggggtgcagtatttccctctccctgacctgcaatttgatcaatatgagatacgacctctgtcgtaacgtcagtacctctcgcatagtcataactggtttccagttcccattccggttcaccggcagagtctatggtcacagtattgcaaatataaattacttccggcatcggaaagtcttcttcaattttatccaatgccatacctgctgcgtcttgtctggcctgcagacttttagccatctcaatctgccagatagctcttgctctagtccaggttttcaccggatagtcacaagatgaaccataatttctgtcatcgccgtttacaccatcaatataaataccatcaaaataataaattgcataaagttcaatattctgagcatttacaatgctgtcatcctctccagtatcctggcgcagtgaccagtcaatacttgaaaggccgagatttgccacagaccggttgttactgtgcagttttatccggccaagcagcgcctgacccacagaatctgcttttgcaatcgggtctgtattatcatcggtgattgatgctgccaaatccccgccaggtaccactacatccacataccggtaagctacgttcttattaataccgccaaagaatattctcagatcaccatcatgaatattatccacactgcatacctgtaccggatgatctgctaaatctgggaaagcattgatctgaatgtatcccttttcttccgtcctgacattcttttcgataatcagatttccctcatttaccaggatcgtctgagcttcggactcattgccgctgttatcatacattcctccaaggtaaagattttctacaaccagagtcttgttttccggtatgatgattgccggctgtgcggtggaattccatgtgccaagtggagttatcaatgattcttcggcagaagccaggtaaaactctccatcgggaagccgctccaaatattcaccagcattttcatcccccaagttcagggatcgcatggctacaacaattccattggactttttagcctcctcggctgctgcgctccaggttttaagaggagcacgtgggtttgatccatcatataatgcatcatcgcctgccggataaacctcctcatcaatggtcatagctgctcccgggttccagtaaataacctttgcttcacctatagaacggcttgcaatcagagtcttactggtcaatgtatctgcctcaaaggtaaaagaccgggacatgattttactttctgaaccagtatctcttaactgaacagctgcctcagtctcgacctccaggttccagttatcggattctgccagagtaaaatagtccaaaaattcttcctcagttgcttcatccgcataaagggttgtcaccagttcccgtgattctgccatgccatcatcccgcagtttcagaagatactcgccgctgccaccgtcaaatccttccgtcaactcgataatcggatctttccaggtacttgcagacaccttatccaccagcagttcaatattatcttcatcggtatctaaagtataattatcgatatcaaaggctgcttctcctgccgcctttgtttgactggcggttgaggccatcggtttcagtggaagcattttctcaattcgttcattttctgccgctgccgtgtaatctgtatccccggcgttagaaggagatgccgtatcttctttccgctctatattttcctgctcactgcaataatccattacaacgcaaccattaatattgacattctgacctatttgaaggacaccgcctcggacataaaccaattctgtatcatcagggtcataatccggaacttctgcctcaagcagagcattcgtcaatgttaattgtccgccattcacataaaacaacgcgtcactttcataagggcgttccggccaggatgctatgcggatatttcctgcatttaatacatacagttccccgtctttcacctccatcggattcattgcataaatagtaatatcagaaggatccagttcttctttctccatcagttcttctgcacgctcaattgcctttttaagagtttttacaggctttgcaggactccgtccattggcagtatccctcccattcttaccttggttgaagttgcattggacatggttgcattggatgcagttgcttcagcatttgatgcggtcgctaacaccaccggcagctgaccgcccggattccaatatattgcatgagcatcatcagtcaaaggttctaatggcaacgtttccttaatgcgttcccctccacgctcaattggctctaatggcagagtttcctctattcggttttcttcactctcaattggttttaatggcagagtttcctctatccggtttccgtcttcaatggattctgacggtgaggtttcctctatttggccttcttcactctcaattggttctaatggcaaagtttcctctatccggtctgttccgtcttcaacggattctggcggcaaagtttcctctatccaatctgttccatcttcagttatgtctgatggcagagtttcctctatcccgtctgttccgtcttcaattttatctgacgaagacatttcctctatctgttcattgttttttgatgtggtttctgccagaaccataagttcctgagcgggaaagatcataagcaagcataaaaggatggctgtaaatcttttaagttttatcattctgttctctccttttcgtctctttactcttagtatccggccttgacaatttccagattgcccctcctgcaaggagaaagaatattaagcctaatgcccaataataaagagctccttccacaccggttttagggattccggaggttccctcactgtggctcaatggagggattttatccggaatttcagaaggcagctcttccaaaggaatgcttccttctcccggaacaacctttttagagcctgcatcatcgtcatcgctatcattgccatttctctgatacaaatatatggtaaccgtctccggttcctttccacccttcaatgtatatcgtccacttcggggatagggattccagcccgctttataaacccggtaccgaactctattactgcttagatacaccagcataccattagatatataattgtcaccatctttgatgaactgttcactttccggtgcagaaagagcggtactattgaccacctccaactcataaataccgctactgtctgtcatgccaaacaaaacataacggttcaggctagggatgaaaatttctacagacacgccttcaagtggattattggattcaatatccagaaccagaaaacgcattttccccatataatcaacgactacacctgccataatatcggtatctccatttcctttcggaacagctccaccgcctgaacttttcccgtccgcccagaccggaaagcaaacaagcagaatcaataagctgcatatcggccatgaaaacaggagcttttttctatccataatatctacctctgttctatgtatttgttgataaagtacatggctgtcagccgcatccagtcacagccattccgcccaacaggctaagccgtcatttttttaactcttgttccttttcccggcccttagttcgcagacttaataatcacaaccacgttccaagccgtttcccctgcatattcttcaccttgtgtataaaaatcccaaaccgcagtacagggataaaacccttgtttaagaccgccagccaagcgaattttttcaatgtaatatccaggttcaagcaaatcagattcataaaccacttctccggttgcatcccgaactattcttacagtacagctgaatttattctcacttccatttgcaatcctggcttctccgaaagcatcagcataatcaaaataaatctgacgttccaaagaaacatatttcatattttcgaccaattcctgatttctcaaatctcttacaatagcagcatcttcaccttcagccagttcttgtttccactggagttctgatgtggcatactcttttcggagtttctggctgccaactattttctgcaagcccatgccggcaaaaaacgaaccggccagcaggcaggcaacggctgtaaatattaagtaatagcgatttttgcagtgattgagcttcattgatagaatgcaccctccatcacatgaagtacaagttttacatttgcctcggagatcttatcctcagtctcatccaatgagtatgtggtaaagtgtgctgtcgcctgataatctcctgcctgaagcgttttatttaactcgatatattcaatataaaatcccggatcaatcaatcccgactgataaacaacatctccagtgtcatccaacctgatatcaacctgaaaagaataatggttagccgcaatattctcaattgcaatcctccctttctttcctccatattcaaataccggaccggcagcaattccgatatccaccatgccttccgctaccttggcacctaatatatccgcgatttcctggtctgtcttacctggaagcataccacccaaagccaactcatctcttgttaaacggcttaaattattgtctctggtcatctgataatagatacctgatccaactccaatcaaaagcagcaggagaaaaattatgatccataacaacttgctttttttcttttctttttgtagtgtcatttttccaatcctttacgtttcttttatattaaagatcaattacggcataacctccgaaagttcccccggtattacctgccaaaaaatcgctccgactttcagtgactcttcaacctgcttatactcattctgcattccacctgttttgacgcctactgtgacatatgtttctgaaggtatatgagcagttcccgccgcagtatagccatttgtcagcacatcttccggtgggctcaaggcaattatatcagcataccaaaacacatccttaagctccgtgctgccatcttcataactgattgtcatttgtccaggatcagaaaatgcaacattatctattagcatctgatactctttaaaattagtcggcgacgaagctccatcccatgtcggatcataactcaccactttccagtgatgcgtcttcccgctatcgctttcattacttgcaataaagggctttagctcaaccggcaatccctctctcggaggattctcttcgtccaggtgctcttctcttacatctgttgagtaattcaggagtgggatcatatcttccgatatggtctgcaattcatactctgccgttgttcctgctccggaaccggagggtacactgacaaatacctttacattcggcacaagtaagtttccattctcaactgataccggatacgtatcaccgctgtcaacacttccacgcactacaaatccatatgccaaaggtacggttactgaaacccttgcttccgatggtatctgagtgacactcagccatacattggatgtcgggccttcgcttgctaatgcagaaaagcgcagactgatcacacatattaatccaactgctgcaagtctgactttatattttttccaccgtcccatatgattcatttattttcctcttttccattcaggcttattccggaaatctcttgcaagtaaacagctcttttccctgcagtttattcgcaacaaatctccggagaatctcttttcagagattcttccgggatcttgtcttatcatcattggttcttatatactttccttacattaaattaaggctgaagataatcctcgttaggtgcggtatcgacatcaccctgcatctctacgctgatcgtccatacaatgttaccaatctttgcagactcttccacctgcttatactggcccttttttccacctacactcacatcgaattttgcatgatgagtctctcccacagttgcataatcattactgtctacgttagaataacttaaatcacctaatggatctgtgttaggcgctgccaagttaataccggcaccagacatctgaagtccgccgtttgccactgtatcaaatttgtttccatcaatgcttatattgtatttcttaaaatcatctgttccagtgttgctgctggttgtatgggtccaatattttctagatgcatcatccccttcattcttgatatttccattaattttaactgcaagaccttctcttcgacccgaaatattcttaaaagtggaatagtttgtgaatggcagttttccctcaacagtaagattcccttctgtctgcaggttataaaccgcaccttgtccgttcgttgacggtgtggttacgtctacctttacatttggtagatatatgtctccgtttgcactggttacagaactggtattacttacgtcagtcgtaccttttaccacaaatgcaaacagagttggaacttctacttttacttttgcatccttatcttcgataataacacctgcccatatatctgtgccggttgatgcaggaacagctcctcccggttcagccattgccggcatcaccatacttgatgccattacgcctgctaataaagctgttatgagtctttttttcatttttctttctctcctttttgatatttgaatttaatgataaaaggtacaatagccctttctacccaatggtaatcaacggaaagtccacctgattctcaggcctttcctgattgtttgcggatctgccgtcatcagcctgccagtaaacccgattcctaaccggataatccggcggagtacaaagaaacacctttacttgaaaggttatttcccgttcctctccagggaggattctttccagcagccatgttatatactgctgcccatcaataacaccatagataccttcgtcttccactgaaacaaaactggtatgctccggaagataatcgcggatacgaacatccttaatttcttcttcactgtcattgcgaagcacaattttatatgtaaggatcccatttggaagtaccagtgactgcatcccatggctggcaacaacctctgtgcctaaagaaatgttgatatccaatgcctcttctgattccccggtactttcagccggtttttcgttttgcaaattcttttcctggaattgagattcttctgccggaggttcggcttccgtctcagtctctgttgaactctctggaatcctttccggatttgttgtttcttttaaaaatgtaatttcttctctgtctgaccccgaatccctgcctgagcccgaatcttttgtcggacgatgtgtctcctccggcggtatttcctccgtggttgtctctgcttcggtcgcctccgacgcactactttcctctgcagtcgtctcttcctcggttgtctcctgcagactgctttcctctgcagtcgtctcttcctcggtcgcctccgacggactgctttcctctgcagttgtttcttcctcggttgtctcctgcggactgctttcttctgcagttgtttcttccggttctgtggtacttccgttttcaggcaaaagcaccgccggaatcggttcatcatatcccggtaaatcaaacataatttgagtcggttcatctacaggaacaaaaccacaatcataccaatatgtaattgtaatacttgaatacatgtttacttcttctttaaactcagtatagaggataatatcactgttttccgtataacaaagcattacatctccaacatggactcctccgcttagaactaactcttcccagaattcgctttccagggaaagtccttcaatccgccccagattccatgttacactgtctccggcccccaatccatttgcctgtggataaatcgtcacttttagctggtgtttaacagcagtatcgggtttgattttcttatttctttctatagtaacattccaattatcactgttaacaatggccactccatttaacgaaacctgaaaccatgtaggaataatagcatctccattgtctgattcctgttccaacagttcctgcaaactcgattgtcccggaagttttgcaaataacggtgccgccaatgatctcgatgatctagaaggcgtcgcctttgttcctgctctttccccttggcttttacgccaaatgagctttcaacatgccccgtttccgcaaaggctgccagtgaaacagcagttatcaaggctactatcaaacccgtacttgcatataacttggcaagcccattaaatctattccggtttttatccatatcttcacctctgtttcactcgattaacactgcgctactactacgccctctccgccttcttctttcacaacatcgcctaaaccatccagatctttgacttttcggttactgactgcaatgatgcaaatagcagccggaatgctgcatattaaaataaccaattcaataatgttactgaccgttataagtcatcacctcctcttaagcgccttagcactttctctcttgtaccagttcagaactaaaccattgtaccaaagtaccgcaaccgtcccccccagatacctccaatcgatgctgataacgcaaaatccatccgattgatgccatactcctcttcctgagcagagctagaatcagaatccggtaataatggatttattctgactgtccgcaattcttcccgatggcatccctgacactctctccgctcaattcttataccggaatccggcctttcttccaccactttccattctccgtaatgatgaccggttgccggcagatattctatatatgtatatccacacaagatacatacattttcaacttgaccttctgactcttctgagttcagtattaaaatatgactttcaaattcatgctgcttgccatcgatgcagtcaggatgtgtataagcatacccgacttcacaacataggatggttaacaataatgtgctcagcaacataagaagcctttttcttaattgcaattacctgtccccctatcctatttttattaaaaaacagacggttgtgataattccatctgcatatggaatttggttaattcctttattgggcctaacaattcctttcaacattaccttaccccatttttttcattttgtattgatttgcggataaacagcaatatttatgctccaaactacaccactgctcccgattcagcgtattcttccatttcccgtttcaattctgagtaatagcttcttcctactggcagcaccgttcccgtatccaatattatttctttaaacgaaaaagttctgatatgagctattgccgccacataagacttatggacccttacaaaaccataatcctttaaccttaattcaatttttccaatggttgaatagaaactaaactggtcgctgccgtaataaacagttacaattcgtttaacaacctcaaagtaatgaatcttttttatctcaatttttcggaattcacctgcacctgtacacataatatattctgtttgcttttcttgtactgattttactgcctgcatgaaaatatcttcgaacttttctaccgttgtttctccttttacaacgtaatgcaatgccctgacatcaaatgccgtagtataataatctttagatactgtaaaaaacacaatttcactgatacacccctgatctctcagcttcctggcaacctcatccccctgtatcccgttcattctcatatccagataaataatgtccggataattcttgaaactttgcaaatggaacagtaattcttcacccttgtgatataaggaaaactccgcatcaatttgatgaattgatgccaacagttccaatcgctttttacattgtttcagttcttgctcattatcatcacaaattgcgataatcacgctttatcctcctctttatgtcaaacaccactttataagtgcctgcatttagttttcctgcaatctgtttttaaatataccgttactcgtttataccatacttaaactgggcagcagctattctctccattgacagcgtcttgtccccgccggataacaagagtatacgggagctgccttattaaagattgtacaaatttcaaaagttgtaataatctgaaatctcatcgtatttcctccaaaatcatattcttgaacttcacttgataagtatatattaaacttggatgtccttgagttatatgtattaaatagaagtttataggtattaaatttaggagttttaaaattaaaaaacattcagctgtaagtgttttatagattttttaatgtcaagtaaagctttttcaatcctctgatgcggtttcccagctcaacaccaccaatgcagacggaataacatcatctatccgaaaagtaacaagaaggcaacggactgcagccaattatgcggatagctgacattttcctgaagaaagcacgggagaaacaagggacggttgatggagcggtttcaagtctatcataactggtcttaggaccaacaataacagcagcaaaccattgaaaaacagactgtctggaaaataagatgaaagccattaaaaaaaaactcaattatttatgtaaaatgcatggtcatgtaagaaaaagtgaggtaaccttgcctcagtatgactctttcgacaaataaaacggtgaggagtttttctttcagatcctcctcaccgcttctctttattaaatggttttctttctatagggcaggcttataccaaacataaacaatgataaaagaatcaatgtcccatatatgattcgggatgtgctatcctctcctgttttcggtaaatagtccaatttctccttgggtacttcttgttcatcgatatccacacgttcgctatcggcagaagatttgggaacttcctgttcattgatattagtactggtgttattaccagcattacctgaaacaacaggtccgctatttcctccactgctgcctccaccgctgcctccggttccacctccactatttccgccgttgttattatttccgccttctccgtttccgccgttgttattattttcgccttctccgtttccgccgttattgttattttcgccttcaccgtttccgccattattattgccgccgttgctatcttccttccaagatgcccacagtgtcatattctctgtaacagtaccattttcaaaatcccacatgacaggcttatcattttcatctaaatagccgtaccagcctttgaataagtagccgtcccttgtggggtctgcaggcttatcactgacttttcctcctacaggtactgttgtcttataaaaatcttcgtattgtgtgccgtcttccggatcaaaagcgactatgcatgcttcttcccaggctgcccacaaagtagtattctctgcaacagtatcattttcaaaatcccacataacaggcttatcattttcatctaaatagccgtaccagcctttgaataagtagccgtcccttgtggggtccgcaggcttatcactgacttttcctcctacaggcactgttgtcttataaaaatcttcgtattgtgtgccgtcttccggatcaaaagcgacaatacatgcttcttcccaggctgcccacaaagtggtattctccgtaacagtatcatttgcaaaatcccacatgacaggcttatcattttcatctaaatagccgtaccagcctttgaataagtagccgtcccttgtggggtctgcaggcttatcactgacttttcctcctacaggtactgttgtcttataaaaatcttcgtattgtgtgccgtcttccggatcaaaagcgactatgcatgcttcttcccaggctgcccacaaagtagtattctctgcaacagtatcattttcaaaatcccacatgacaggcttatcattttcatctaaatagccgtaccagcctttgaataagtagccgtcccttgtggggtctgcaggcttatcactgacttttcctcctacaggcactgttgtcttataaaaatcttcgtattgtgtgccgtcatcaggatcaaaagcgactatgcatgcttcttcccaagctgcccacaaagtagtattctctgcaacagtatcattttcaaaatcccacatgacaggcttatcattttcatctaaatagccgtaccagcctttgaataagtagccgtcccttgtggggtctgcaggcttatcactgacttttcctcctacaggtactgttgtcttataaaaatcttcgtattgtgtgccgtcatcaggatcaaaagcgactatgcatgcttcttcccaggctgcccacaaagtggtattctccgaaacagtatcatttgcaaaatcccacataacaggcttatcattttcatctaaatagccgtaccagcctttgaataagtagccgtcccttgtggggtccgcaggcttatcactgacttttcctcctacaggcactgttgtcttataaaaatcttcgtattgtgtgccgtcatccggatcaaaagcgactatccatgcttcttcccaggctgcccacaaagtggtattctccgaaacagtatcattcgcaaaatcccacttaacaggctcatcattttcatctgaatagccgtaccagcctttgaataagtagccatcccttgtggggtctgcaggcttatgggtgatttttcctcctacaggcactgttgtcttataaaaatcttcgtattgtgtgccgtcatcaggatcaaagataaccatcactgtctccggctgcggagcatcaaaagcctctgccattgtttccacagttgtttctgtaacttcctcctgctggataagaggtatttcttccggtatgacactctcatcttccaattctgcatgagagagagtttcttcctcatcaacctctgccggaacttcctcttccaataaagtcaggtcatcatctgccggaataatattttctgtttcatcttcttcagtattatttagttccatatccagctcttcattaaataaagaaaccgtttcatcatttgcatatgcattcattggtatcatgctacagactaaaactactgtcatcagtaagctgaaaaatctaccaattttacggtgtgcccttttttgcatgttctttcctccttttttcgattacgccttaatttctttcatcggcgtcaaggagggcagcaatacagtagcagccatcgaaattaatccagtttcttttaaatatcgagtgctctttcttgaataagatcacaaattctagtaccgcgcagcatttcaatcattttagactggatggattccaaagttcgatgcaccagacatactgaagcagcatttctgctgcaaaatccatcctcttccagacatcgattaatacagatacttccttccatagcctcaacaatatcgtataatgtaatatctgaagcatctttagccaagcggtatccccctttggaccctgcacggattctataaatccctccattctgatttttgcagcaaccttgttgaagtaattgtaggtcattcccaaatgagccgctgccgccttggcagttgttatttccatatcctgccgagccatataaagaataatccgaatagcatagtccgttgtaatctgaaatctcaccgtattccctccataatcgaatattccataatagtttaaatactttacgtcaaaagtatagtataaaacttggatgccctggaaatatatgtacttaattagagttttcatgtactaaatgataccattatcaggaaatgccgatcatcctgttgtaattaatttagcctcatcaaacagcaaagcaaaggggctgatttttggtcgttgggaatgatcaggcaccccctttatcttataccagtattcctccgccattcaccggtgcttccatttatgacttttataaatgccgcaatttttttaattatgaaacggaagaaaatgcctgaagtcattcagacattttaataggaagaaagggctgcaggcgctgacggattgatatatagctttacgcccaatagaaattgtgctaagatagttagtgtaagctaaccatctgaagggggttgtatctatgttcaaacaatttattcaaaatacaagaaaaccggaaggcacacttggcaggatgatgctaaaaggcatgaatacgggacatgcaaaactggcagcatgggggttttcgcacctgactttgcggaatcacactcatattctggatgtaggctgcggcggcggagccaatatcgctaaaatgctgaaggacgtttcagagagtgtggtggatggtctggattattcggcagaaagcgttgctttcagtaagaaaaccaatgctgactatcttggaaaacgatgcactatccaccagggagatgtctccagtttgccgtattccgaccacagccttgactatgttaccgcttttgaaaccatctatttctggccggatccggatgccgctttcaaggaaatcaagcgtgttctgaaaccgggcggtatcctttttatctgctgcgaatccgctgatcccagcaacaccacatggactgaccgcatagaaggaatgactgtatatcggggagaggatttgaaaaaaagactcttgaaaatcgggtacttaaaggtggaactgcacaagaacaaaaaagggtggatgtgcctcacggcagtttgttgattgccgccttccataacagcagaaataccaagctccacggctttttttgtatgcgaaatgattaattttcaaaacagtaaaaaaagaggccgattctcaataatcaacctctttctgtaaaaacaataatgcgggagatgggacttgaacccacacgatcatacaaccacaagatccttagtcttgcctgtctgccaattccagcactcccgcatgtcatataagaatttaaaactatacaactatgaccgcctgtatagtttcatgcagaagaagggacttgaaccctcaaggtattgctaccacacggacctgaaccgtgcgcgtctgccaattccgccacttctgcatttcgttgttatctctcgcaacaacaatagttattatagtatacaagcattaatctgtcaacaacatttctccaaatttttcaaatatattttttgtatatatttttcaaaaaatattgacaattttaaacaacggtgctaaaataaggttcgttgtgcgggagtgctggaattggcagacaggcaagactaaggatcttgtgtctgtatagacgtgtgggttcaagtcccatctcccgcatttttttatatttttatttttttctattgacatatttaacttttcgggtataataagtcatgtattcctcgatagctcagtcggtagagcaaacggctgttaaccgttgggtcgtaggttcaagtcctactcggggagtttttttattgccaaaaacattgttttcccggacagaactgaattgatacggtaccagcatcaattcagttcttttataacggcgagtatcccttcattgtcattattcagcgtcacatacgccgcactttcctttacctcttccggcgcattccccattgcatagctgtattttacagccttcagcatatccatgtcattatacccgtcaccgaatgccatggcttcctccagagagattcccctgtgattgcataaatggcatattcctgttgatttgtttgcatttccatgcataatttccagataattctttttagacagaacaattgataattcaggatattccttccttaaacgagtttccacgctctgtatttcctctgactctcccatcaataagagtttatggatccctccttcttccgcaaattctttttccatatccccttcttttgctttcaatccagtaatattttcttcttcccggacccagggatcattggcgctgtccacaatccatttttcatagccgtaagtattgaaagatatccggggaaattccgctttcaatatttctttgatctttaacgccttatccatttctaaaagacagctatacaatatttttccgccctcatcatatattaagccgccgctatagcaaataatgggactatgattgccgatctggcgctgaatgcttgtcactccttccggcatccttgctgaaatcaaaacaaatggtatccccttttgttccagctctattatttttttgcaggtgccgcctgatacctgatgacagttatcaagcaacgttccatcaatatcgctaaaaattattttcactccgtaagataccttgttttgtattttcatcttatactctcctgtttctttgtctgcttatacttatttcgtatgctctgccggcggaaatacataatttccaggttcccaatatacaccccttgcaacgctgtaactaaccatagccaccgcagtttcatgctttcagcacaagaacggactgccgaaatttcaatccgcagtccgttctcttatcacttactcttccatcaatctttccacaatattcactacgccgtctgagccggcagaccggatatatccggtaaattcttcaacagaagaatacatctccctttccgttaaagccgttatcaccatgggaagattgactccagccactgcctgcagattatatccctccgctatcagatgtacaattgcattggaaggcgaaccgccaaacaaatcaaccagcaccagacatggcaggtcatttttgaattcttccagcttgttttttaatgtaccgatcagactgtcaagagattggtccggacggaatggcagatacgaaaagttctcctgctctccgattaccatattaaccgtctgatacagcccttgggccatttcgccatgggtcattgttaaaatattaaccattcttcctccctataaaatgtgcagaagcgaaccggcagctccgattattattaaaatcaccaaaagctttattaccgacatgttctttttatcatgtaagtaccaaatggccatgactactataaatggaagcaggccaggcatcaagccatttaaaattgtctgcagctgtgtggtgctttctccgtttgtccatgaaatcggagtggacaaagatacgaattgggcagacagtcctccgactacggtaagtccaagaatggaaagaaaggatgttgctttcgcaatcatagacggagagaaaatctcggaatccatgatttttaggccttcccggaatccaaactggacgccccacatggaaaatccaaaggtaacggccgtccaaagcaccataaagataatgggtcccagaacatttccttccagcgccagccccatgccaaagcttagcaaaagtgcattgccggtgctggcaaaaagagaatctcctaatgcggccatcggtcccatgaggccggatttaatggcattaaaaacatcatccggaatatcctctccctttgctctttgaacttccatggcagcaacagctccgaccaatggagtgccgattgtaggttccgtattaaagaatgacatatggcgggttaatgcggctcccatttcttctttgtttttacatatcttttttaaaacaggaaccatactccaggcaaaggctacattctgcatacgttcccagttccatgcagatgtattggacagcagccagcggattcctaccttatatatatcttttttggttacttctatattaccacgattttcgctcatgagtaaaccccctcttgatttgccttgcccaacatgctgatcatagccagggcagctccaattaacgccactgtaaagataggcagtcccagtgctgcaatcagtataaaaccgagtataaaatatcccagaagggatggtgttgacagaagcattttaagaagaacagccatacctaacgcaggaagcatgccgccgatgacagtgatgatctttgtaagccactccggtatgaactggacaatattctgggcagcagaggccccaaagtacaacactaaaaataccggtatgaaccgaagtacaaaagcaatcatctgaggaaggccaagagtcatgaaagtaagctttgccacgttgccctccgccgcatacttatctgttttatgtaccagaaaggaattgatggtggcaaacagctgccatacaaatgtccctaccagccccaggggaacagctatggaaacagccatttctgcagatacagccgttgataaggcaagagcagtgcccacatatcctgcaatattaatatcagatgccatggctccgcccggagttaccgcgccgatatataaggcattgatggtggctccgataatgatcccgtttttcacatcgcccataataagacctacaatcaatccagccacaagaggttttccaaacacatgataggaaattccctgtcctcccagccatggagtggcaatccaggccagataggcaaaaagtgcaataagaactgcttgcaaaaacgtcataatctctcctccttatcctcagaaccggttttccggctgtccgggtactgtctgcatgaaaatttccacatttttgtgatcctttaacccacatacggccgcataattttcttcatccaaatgtacggtctgggcgaacttttttcttcctcccgccatgcccacattcccaacatttacggtccacttataatcgggattggcgtctatgatccgctttgccgttaccggcgctttcgtgataatcatcacttcattttcattgtactttgacaggaccttcatcccatcctccacggttgcaacaaccagctccacatttttgggagttgccattttcaaagccttggtgataattatattcgttgccgccgtatcatcaacagcgatgatcacctttgctttcagctgcttcagccatgcagttactacctgcccatgtaccaaacggtcgtctactcttaaaaacatattccctcctataacatttataatgttttttagttgccatactccaagcaaaacaatctgttcctccatcattctctgctgccgtttctcctgccctaaaaaaccagaacagaaaccggcacactcccctggcgccaggctcctatgtgcccggtttatttcacagattctgacccggccgtcataagacgctgcatatatgcttgcttctttctgcttccctccagttgttctggtaaccgcttagaagatccacaaaacgctttgcagtaagatgaggcctggtaatggcacttcccaccaccaccgtatgtgctcccagaaacatgcatttcatcgcatcctccggggtgtagatatggccttccataaccatataagcattatctccaaaatctctgcacattctcgcaaattctcttaaatcaggcaattcaatatcttttgtcgccgccgtatacccgtaaagcgtaggccctactaaatctgcgcccaattcaaccgcgcgttttgcctcatcatatgtagagatgtccgcaaaggtcattgctttcggaattgcttcttttacctttgaaatcagctcataagcagccgtcttttcatgagtgatctgttccgtacagtccatggcgatgatatcagcccctgcctcccatacctcctttgccgcttccagggtcggtgtaataaacacctccgtatcatcatgccagatcttatacaggccgatgatgggaaggtccaccgctgcccggatcgcccggatctgtttcggggaattggctctgattcccaccgctcccgcccattcagcggcttgtgccattttcaccacaatatcgttgctgtaaatgggatcatcctgctgaacctggcaggatacaatcaacccgcctttgaacgattcaagaatctttcttttcctagggtcctgcgttttcattatgaatcctcctcgttttttggtttccttctatgataagtacattataacacacctcacattcaatctcaatcattttttatcattttttatctttttttataatacaaatcattgaattatcattttttatcatttatatgtaataagaaagtcatgtcagaaagaatgattattgtccgacatgacatttctattgtttgtgtacacatttcaataaaatctatataattttaacattttccggataaccgcggtcttcctcatcccctcttttatcacagattatgctggtaaaggcagaggtttcagccagcttcaaataattccgtctgccgatcttgctgtgatccaccaggagataggactcatatgcattctccaaagcaatcctcttcataagaaggctctccatctccgtagtatataccattccctgggaaaaatccacgccggagcagcccagaaatgctttgttaaaataaaactgcttcagcacatcctgagcaacagggcctacgttcatgctgtaataggggcggtgctgcccgcctaccacaaatatctcggcaaccggattgtgaatgctgctgatcaacagttcgttgtatgttactattttgatttttcttttctcaagtatccgcatgagaggaaccatggaagtccccgcatccaggaatacgctgtcgtcatcctgaacaaattgggctgcaaactcagcgatccgttccttttcctttttatgaagcattttcttctctttcattgtaagttctgctccatctggggccatctcctggtccgtgtccaaagtagctccgcccaggacccgtttcagcttgccttctgcttccagtttttcaaaatcacggcgtgctgtaatctctgatattttcagctcttttgctatttcttttaaattaataatgcctttttcatttaactgctgtataatataccgtttacgttctgttgcaatcacaggtaacacctcctcgtatcttaattcacttatcaatattttatcataaaatatcttttttgaacatattcctttaaatgtttttcaattttataacaaaaaatttcaaattctgccgtcaaaacaggaaggacccacaccgccaatacttgtaacgctgccgaagccgatgggcagaaaatcaagcctgtctgtcagcaggtcatcactctccaaggaacggaacagtacgggaaaagttgtcgtttttacttcagcgcctccttctctgcgtaacatgatcttgaagatggatattatcccttacgatcagaaatttttcagtaaattgtcgtttacagaaatacaatagccccgaagacaaaagtcccggggctatttatagtcaatgattgtgttattatatttttctgccggcagtcacgttattcaacgcgctcacctgttaggatggtatttaaacgcctgttggggtcacattccagagcggaaacttaagtttcctgcaggcttatatcttatcctgcatcaactagcatccgcaatcatcatcgttgcgccaacgggaagcactgttacagccatcccgaaaacctgcacaataagcttctcttctttccttttcgcattcgtctttttcagcttcacaattacatttattattacatccgctattactaatgcagccacagttattgttacaattacgtctgcagttgttattacagccgccccaaaaacaactcatattgcacctcttttattaattttatatcttattatatgggaccggaagaaaagatgtgcatgctgtggaaggcagtgctgactgcctggtcagcctgccggctataccaggctcagtattggaccaattaacaatgatttaatttatttaaaattaaaattgtaataacttgaaacacgctatttatactgtcatataatatctaaatctattttttaggtacatttatgaacgtaagcattggtatgacagctcctgattttactgctgtgacaacattcgggcctataagactatcggattataaaggatactgggttgttctgttttctcatccaggtgactttactcctgtttgtactactgaatttgtcgcttttgcacaagcaaacgatcagtttgaattattaaatacaaaactaatcggactgagcatagacagtaactcttctcacctggcatgggtaaatcaaatttatcagttaacaggtattcaaattccttttccaataattgcagatcgtatggccgaagttgcaaacctttatggcatgattgctcccgatacctctacgcaagagactgtacgaaatgtttatctcattgatccaaatcagaaaatacgtgcaattctaatttatcctttaacaaatggcagaaacatttgtgaaatactccgtttgttaactgcccttcaaatatcagataaatgtggtgtcgtcacccctgcaaactgggatccgggcaaacctgtaatgactccacctccccgcacctatgatcaattgttagaacgtgccaatgagcctcaaatatcaaatttaaattgtatcgattggttttggtgttataaagataagccatgttaattatgtaataaaaattcacagacgggccagtttgtccggtgtctccggccgatccagccaggccggctcttagcattcacagccattttcggtaacaatggcgctgagtgttataccaccgataacaggactgacattaaatgtaactacaaccagataggtacagcattcattcatacaggaatcacaatcacatacattaaaatgaatagaatcagatactgtaccagttgcccaaaaagagaaaaacagggtgattctgcctgggcaaataaccctgatattcagaattgccatttatagctgttgtttgctattttgcataacagcagaattatgctcatagtcatttataattgttattgaggtttcaaacaacaactactcttgttacaattaagaaaaacagaagaggctttgttcatatggatataaaattaaaaacaataatattagaatgccgtaatataccccaattactgtctttttacacaggacttttgcattggccagtagtctttgaaatagatacttttgttgggatacattcaatggaagaggatattggaatcgcttttcaatatgataaaaactacatctctcccacatggccctcacagccagggcagcaacagatgatgtcacatttggattttgcagtaacagataaaagtgaattaaaagaagcaacggaaaaagcgattgagttaggtgccagaattgctaacgggcaatatggcggtgaggaatgggttactatgcttgatcctgctgatcacccgttttgttttgtcgtatggaatcatgaatagtaaaacaatattttaatccaaaagcagtattctataaaattaggatactgcttttgccttatttttacctaacgaaataggcttattaactgattcttgcttatgaattttttattgacctggtttgtaagataccacaaagagtcatctttctttattcttccaaatacttcctgtattattatttttcactcagcgcactatatttttgaggtgatttaatgaaaaacaatttatccaatttactctttaaaagtactagtaccaggctttactttataacactcccagtttggctgcagataatactgcatgaaaatcattcatacattaatactgctgctcaattgcaccatgttgccgggatattattgcagcaaaaaaacctgattttgccgggtctgtctaaacagtgataataaattctccaagcattcctttttatgggatatttactcttcacttattggattttttcaattaaaactaagctttaaataacactctgacaggttacaaccccatcttcagcaaaacaggcttcttttaaatccatgtaaaagaaatctattttactttgcgtccttatattcttttttccggctctccggggaatcctaatttcgctcttctaacctcctggcaccgtttttttgtactttgatctatattccggcatagtgtaatcacatatatggggaagctttttcaatgaaaaagaaacacgaacctgcttgccggctttgcgccgaaaaagtcccatatgttcctaccgtccaaaactatggcatagtctgccggcggtttgaatctcttcattaaaggaagcttgccatatactaattatattatttgtatatcacgaatcaatttttttcatttctcggtacttgagggcaaaaaaagccccgcaaacacgaggtttacggggcttgtatactcaattaagccactttggattttgccagctctgctaattttgcgaagccttctgcatcattcactgccatgtcagccagaacttttctgtttaaatcaactccagctaactttaagccgtgcataaatacactgtaagatacaccattgatacgggctgcagcgttaatacgggcaatccataactgtctgaactgtctctttctttcttttctgcctgcataagagcttgttaatgctctcataacggactgctttgctactctatactgtttggaacgagcgcctctatagcctttagccatctttaacactctgttatgttttttcttagcgttcataccgcctttaattcttgccatcagtttttcctccttcttaacttaagatcctataaatatggtaaaatcttcttcattacttttgcgttggttgcatcggtaacgatatcttttctaaggtttctttttctcttagtagatttcttagttaagatgtgagatttgtaagctttatttcttacaagctttcctgttcctgtaactttaaagcgttttgcagctgatttgcttgtttttaatttaggcattgtattttcctccttgataatgttctactggcgttttgcattcaaaaatataatcatgcttcttccttccaccttagctggcttgtcaataaccgcaatatcggctaacttctcagcgaagtcatccaaaatataccttgactttgacatatgcgccatctcacgacctctgaaacgtaaggttaccttaactttatctcccttttcgaggaacttccttgcggcgctcatcttcgtgtttaaatcgttggtgtcaatgttaggagataaacgaacttcctttacttcgattaccttctgtttctttttagcttctttttctttccttgccagttcataacgatatttaccataatcaataatcttacaaaccggtggttttgcagtcggagcaatcttaaccagatccagttctgcttcctttgccatctgcaaagcatccctggtagacatgatccctaatttttctccgttttcaccaatcaacagaacttccttatctctgatctgttcattaatcattaaatcgctaattgtcgtgcacctccattatatagtgtgtgttggctggattccacattgcttgcccataggcataaaaaaagtagatagacaaacgctatccaccaccaaagtctccataaagtacacctatgtaccaaaggctatgaaccagggacacttactcgtgccgtggtgaggcggatacctactttcctgtttgctgttttcacaacttatgttataatactatatatttagctttctgtcaacatatttttcaaagcatgcatactttccttataatatttttcttgcaacttcccaacatcagggctacaatcataatatgtaataaaataaaaacatcaggaggcatgatatgtggtttgttttcgctcttctttcttccatttttgccgcctttacttccattctggctaaaatgggaattgaaggagtcaattccaatctggctacggccatccggacggttgtggtggtactcatggcctggatgatcgtttttctaacgggagcccagaccggactttccgaaatcagcagaaaaagctggctttttctcatcctgtccggccttgccaccggcctctcctggatctgctattacaaagcccttcaaataggggaagcttccaaggtggttcctgtggataaactgagcattgttctcaccgttcttttggcttttctcatactccacgaacaattcaccatgaataagcttataggaatccttctgattacagcgggaacctttgttatgattttatgaccggcagcctgttcaaaataaaatgcgtcaggacttatcctggcgcattttatttccgcaggtttatctggttttaaaagttgaacattcggtatgctctgatgagcttgcaccgtctcctgcaattccgatgtgctctgctgaacagtgtcggccttcattgtatacgcagttgacagcctcgcagtccacctccaggcggctttccggagttttgaacaagttatggaaggtaccgtccttattctcatcaaagcttccgcagcaggtatcatagctgtcctttgcctgagatccctctacgatgatggcggacttgcagcaataattatcggaattgtgaagacagcttgttacattacagtctaattttgtcatggcccatttcctcctgatattcttacttaaaatgatgtttcaggagtagtatgcaccttgaaaaaggaaactattctcacaagcctttctctcgctgttttcatgaaccatgacaagttctgtttattttgcttcttctgttacatttacctttttgatttcctttgtgcggatctcacggcagatatcatcaataaaatcggaaagcgggcgctgtccctcatcgccgttgaaacggctgcggacagatacaacaccatcttcttcctccttctggcctactaccagcatataaggaagctttgacaaacgcgcttcacggattttatatccgattttttccgcacgctcgtcaaccgttgccagaatgccgttttcctttaactgagacgcaaccttccctgcatattcatgatatttttcagaaataggaagaacgcgcacctgctccggacataaccaggttgggaatgctccttcgtatttttcaatcagccatgcaagggttctttcatagcagcccatggaagttctgtggatgatataaggacgtttctttgttccatccttatctacaaagctcatatcaaaacgctccgctaagaacatgtcaagctgaatggtgatcatggtatcttccttgccgtatacgttctttgcctgaatatccagctttggcccgtagaatgccgcttctcccgcagcttccgtatactggattccgatgtggtccaggatctttctcatcatgccttccacttcatcccacatttccggtgttcccagataatgatctgccttgtttggatcccatttggacatctgataggtcacgtcgccttccaggccaagagttgtgagacagtatttcgccagatccacgcagcccttaaactcttcttcaatctggtcagggcgtacgattaaatggccttcggaaatagtaaactgccgtacacgggtcaatccgtgcatttcgccggaatcctcgttgcggaacagggtggaagtctcgccgtatctgcaaggcagatccctgtaggatttctggctttgtttataaacatagtactggaacggacaggtcattggacggagggcaaatacttcatcatccgtttcctcatttcccagaacaaacatgccttccttgtaatgatcccagtggtcggaaatgatgtataagtccttctttgccatgagaggggtctttgttctcatatatccccgcttctcttcttcatcctcgatccatctttgcatggtctggacaatttttgcaccctttggcatcaaaagaggaagtccctggccgattacatccactgttgcaaaaatctccaagtcacggcccagcttgttatgatcccggtttttgatatttgccagatattccagatattcatttaactcttcctttttggcgaaagcagtgccgtatacacgggtcagcatggcattcttctcgctgcctctccagtatgctcctgaggaagaagtgagcttaaatgccttgatgggctttgtgctcatcaggtgaggtcctgcacaaagatccgtaaattcgccctggcggtagaaagaaatctccgcaccttccggaagatcctggatcagctctaccttataaggctcgcccttttcctccatgaatttgattgcttcttctcttggaagggtaaagcgctcaatttttgtcccttcctttatgatcttcttcatctcgttttcaattttatccagatcttctcttgaaaaggatgggatatcaaaatcataataaaacccattttcaatggaaggtccgatggcaagctttgcctgaggatacagcctttttactgcctgagccaggatgtggcttgctgtatggcggtaagcagaaagacctgcaggatcgtttaccgtgagaatgcttaaactgcagtcctcttcaaccactgtcctcaaatctacaacctttccatccacttcgcctgcgcaggcatttctggccaggccttcgcttatatcagaagcgatgtcaatcactgacattgcatgttcatattccttgactgagccgtcttttaacgtaatcttcattttccatcaatctccttttcttattattattgtgaagaataaagagtttgcgaagcaaactcttgcgtctgcggcggtcgcataacggcatccaccgcttacgccgcagtgcacatccacagcggagcatttttattttgcagagaagttcagagaacttttctacaaaaaaagcccctttccgtatgtttccatacagaaagggacgattctattcaaagaaatcgcggttccaccctttttgagtgaacaaaataaatgtccaaaccacttcttacgacgataacggagtcaccgttccccattaagggacgctccaagctggtcttctcatgtcattcccgtaaagcgcttccaccaaacacgcctctctctggcctttcctgatatgatactggtcttgtcaatgctttttctgtattgctttataattttagattatagcacggttaagctgtttgtcaagcgtcataaaaaaaattttcacaaaagaatgatcagagctgccgtgatcgcagctatgctgatcacaattgacaaagaattaactgcgcttgccgtctcgatatccccctttaaagcaccggtaaaagcaggtgccaccgacgatacagggcctaaggacacaatggccagcgcctggcgcacctccagcccaaagggcgccagatagtaaaatccaactgccattaataccccgatgatataccgcacccctaatattctgaaaatctggctcattttttccttttccatacggatctcaaaaccgattccaatcattaagagagcaagaaacgcattggctccgcctgctgtatccgcaaggctgatcaggacagaaggcagcttaatatttaatatgcttaaaacagtcataaggacataagcatcaaaaggagccgaggaaaacagcttaagcaccaccttttttatagaaggcttttcctcttctcctatgaccatgctggccagagtataagtcatcccggtgcacatcaccgcatttccggcgtcaaacaggcttgtggccgcaaatcccacagggcttaaaaagctctgtacaaagggcatggtaaaatttcccacattatatccggacatattgatcattgcaaaagctttagtctccctggactttacagcctccatcacatacccggccgcaaccgtaacacagttgcataaaaagccgatgacgcatacaaaaagaagtgaataatccatggtgatcttgctgaaattagaaacaatggctgccggaagggtgatcttgatcacgattctggagaccagataaaaatcctttgcctgaaaaaaacctgcccgtttgagcaggtaccccatgataataattgatacaaatgccgctgcttttatcagtaccgctgtcatatccggctccctttttctttctgtcttttctcaaagtttccggcggcgcctttttatcagctccgccggtgggaattctgtaagattttattttacttctacggcccagccttccggtccctggatgctgccaagctgaatgccggtaatggaatcataaagcttctgggtcagatctccgatccttccgcctcccacagacattctgtcttcttcaaaccgcagttcccctaccggtgaaatgacggctgccgttccggtgccaaagcattcctccattgctcctgatcttgctgctgcaaccacttcatcaacggaaattctccgttcttcaacaggcactccccattctttgcataaggcaatgacggaatccctggtaacgccgggaaggatgcttccgtttaactccggtgtaatgacaacaccgttgatcttaaagaagatgttcatggctcccacttcttcgatatattttctgtgaacgccgtcaagccataacacctgggaatagccctcgtcatgtgcctttacctgggaagccagggaagcaacgtaatttcctccggtctttgcctcgccgatgccgccctttacggctctcacatattcatcctcaatccagattttaaccggatcaaggccgctggcataataggctccaacaggagataaaatgatcatgaatttgtaggtatgagaaggcctgacccccaggaagggatctgtggcgatcacaaagggtctgatataaagagaggtccccggctttgtggggatccagtcctgatccacgctcacaattgactttaatccctccaaaaataaatcttccgggatttccgggatgcaaagcctgcggttgcttctgtttgcacgctcaatattcttatccggacggaacaataaaacccggccatcctctgccttgtatgcctttaagccctcaaacatctcctgtccgtaatggaataccatggcggaaggatccagctccagcttatgataaggtacaattctggggtcataccagccctttccctcttcataatccacctcaaacatatggtccgtgaatatggttccaaatgacaacgggttatctttgcctggcttttctttcgggcaagttgttttttcgattctgattgtttgcatgtgatactcttcctttcctcttaaggtgcccacgctgtctgggtagagcccaccccgcctcagctcaccccgcactatggggtgtaccgggtacaaagggatacccggcgggtgtttcccataccggcatatctgtcagtttttataatttgtctatcattatcttccaaaatgccctggatgtcaagaattttcagcctgttttactctaccgaaatggaatcaaaaccataactttgagttatatggcggggaatttccattctcaccgttttcatgggatttaccgtctggcaaataacaaggtctccggtcatggtaagcagcatccctgcctcttcataatccatccccaccttctccttcataaagccgtacatctgcctggctgccgcacgccaggcttcttccacctgttccttggaggcaatggtgatgagtttatcctctgtctcaatcattggatagggcacacagtttttattccgcaccacgtttatcctgaccgtagcccgtccttctatttccagaccgcagtcctccacttccccgtctcccataagagcgtgaaaatcccccatggacaaaagggccccttccacaaacacaggcagatacaggactgctcccttttttatctgggtgcagtccatatttcccccatggtccatgggagtgatggtggaaacgccctcgcctgcaggagccactccgatgacgccgatcataggctttaccggaacttttaccttttcattgaaataggcataccctccctttacaggcacccgccttaatacttttcggggaaattcctctttttcacttccgctgccaggtcccagcataacaatgcccacaggtcccatctcaatatccagaatatggattttaagcatgtctccaggcatggctccctcaatatagagaggtcctgttgccggattccccggcttcctcaccacattttcaaacgttgcctcttccggcagaaactggtttgtaaaacagtcgtaagtctcaaaagccacggtctctcctgccctgatcctgccacagggaggattttcctttgaaagtacgtttgtaatataatccctggttatgatcttcatatttttctcctcttaattttttcttttccactaagctccggccatacagtgatcagcatggtcaaaaagcaggctccgcctccgatgagattggaaacaggttccgccataaagattccttctgttccgttccccatcaggatgggaaggaggatgatcagtgggaccacgatcaccaccttgcggaagatggaaaaaaacaccgccctccttgcttttcccaaagccacaaacacggactgtcccgcaaactgcagggacataaaaaagaagccaaagtaatagatccgcatggacggaacgcctgcttttagcagctcctcttcctggttaaaaatgcggataaagaactccggaaagccgtggaccagtgcccacatgaccgcggtatatgtgatggacaccactgaagtgaaaataatcgcccgctttacccgtttatattcccctgctccataattaaaacccatgaccggctgtgcgccgttggtgactccgcttacaggcatggaaatcacctcccggatggaattgataacagtcataactcccacatacagatcacctccataacgctgtaaagaggcattatacatgatctgcaccaggctgttggtaatggacatggtaaagcctgacattcccaatgcaacgatatcctttaccctgtgcctttttaaacgaaaacaggaggtctttagctttaaaatggttttctttcctgtcaggaatttaacgatccagagagcagaaagaaactgtgacaatacggtggcataggccgcccctcttacgcccagtcccagaacaaaaatgaatataggatctaaaataatattggcaattgcccccaaaagaaccgtaaccatccccatggtcccaaacccctgggaattgataaagctgttcattccaaggccgatcatgacgaaaacattgcctaacaggtaaatgctgatgtattgatccgcataaggataggtcagatcgctggctccaaacagatagagcatgggcttttttaataccaggcctgatacagtaagtcccaggccgaaggctaccattaaaataaaagaatttcccatgatcttttcagcttcttcctcatttccccgccccctctcaatggagcacataggcgcaccccccatgccgaataaattggcaaaggcaatgactatggaaatgatgggaaggcacaggccaagccctgttaatgccaacgttgcattttccggaattcttcctatatatatcctgtctacgatgttatacagaacattgatcagctgggccaatgtcataggcacggccagctttaatatgttttctattacgcttccttttgaaaagtcattctttgtatctgccatttctcaactgcctccttacctgttttatcataacatcctctttctgattttgcatccagtttttcccggagattcttaaaacagcaataaataccattttaagattattttttatctttcattcaggcttatgttccataacaattctgtcaagatccttgttacaagaacttgcccggctgctggaggcctacttagcggaacacaaccgggcccttctccatccaacggttaagctaaaccttcaaaaggaatctgttttctttaataccagaatcaagcttctgctgtatctgatcctggacacccactccgtccgcagtgcctgtgaccgaatggccttatcctacggcaaagcctgggatatgttaaataaaccggaagcagaaacaggctatcccattacagaacggaaacatggaggcaagcggggcggaaacactaccctgacccccagggcctccagttcctaagaacctggcagaagctggaagataatatctttcagtttgctcagaatgaattttccgccctttttcgtgacagcggattattcctgtaaagcaagtgcttccaaggaagaatttgaaacatttaaatcccccttttataatgacattagaaatcatagtgttgttatagaaggggtgattttttatgcttgaggccagttccgcctgcggtcttatactggccgcaggattgtccagccgtatgggggattttaagccgctgatgccctttaagggaaagaccatgattgaaagcaccattgacagcatgctggcagccggagtgaaacagattgtaatcgttctgggttaccggggagatgatattgagtcagttcttcaccttcattatgggaaagaaatcatttacgcccgaaatcctcactatgagattaccgatatgctgacctctataaaatatggtcttcactccatgcctcactgcaaagcttttttcctgcttccaggtgacatgccggttgttaaaaaaaacacgttccttaaacttttaaaagcacagccccatgaccggcccgctctcctgtttcccaccttggaaggttatcggaaacatcctcccctgattgattacagattccgtgacatcatactggaatttgagggagaaggcggtttgcggcagatatggaagcagcaggaggaattcatcatccatgtaccggtggatgatgacggcgtatggatggatctggataccatggaagattatgaagtctgcatcagccggttttatccggccaaaatttaaaaggaggcaatgaatcaatggaacacatcagtcagccagtagtaaaaaaagaccatgaatcaaagatggcgggccgctctgtttatgtaggcgactatgaaaataacggggtcctggtagggaaaatgcttcgttccaagctggcccgcgcaaggctttctgccgtaaatgtaccgccacttccccacggctatttttatgtcgatcaatctgatgttccaggtgacaatcatgtgaacatcgtcatggacgatacacctgtttatgcccgggaaaccgtagaatacattggagagcccataggaatggttgtggggccggaagaatcggtggtagaccgcatcctggatgagatccaggtttcctatgaagaactggagcctgtcctggatcttgacaaggcagataccgtattctttgattatgaatatggcaaaggggatatggagaaggcctttgctgaggctgataaaatctatgaagaagaatttatcaccggttaccaggaccagacctatttagaaacccagggtatgatggcagagcctgaagaaaacggaaaaatgttcatccacggctctctccaatgcgcctattacgttcacggagctgttatgcgggcccttggctgcggaccggatcaggtacatattaaacaggatgtgaccggcggaggttttggtggaaaagaggcttttccttcaattctgggttgtcaggtggccgtagctgctaaaaaggccggtgctcctgtccgctgcatctttgaccgcagggaggatttggagtttacctccaagcgccacccttccctctgcagatacaaggtggctgtaaaggatggcaaagtgactgccatggacattgatgtgaaattcaacagcggagcttacaccaccctgtccgccgtagtgcttcagcggggtatcatctgctcaaacggaatctataacgtcgagaaccttcacgtgcgtggaagggccttaaaaaccaataccactcctacaggagcataccgtggcttcggcgctccccagacattttttgcagttgaaatgatgatggaccatatagcaatggatcttggaaccgacagcctggaatttaaggaaaaacacattgtaaagcaaggagattccacttccacctcagggaaataccattttcccgtaccaattccttccatgatcgaagagatcgaccaggcttgcggcttccgtaaaaaacacagggaatatgcaaaaccgcagacaggacggtaccgcagagggattggcatttccatgcattttcatggtgcaggatttaccggttccggcgaacgggatatcatcaaggccgtatgcaggcttcacaaatatcccgacggcacggtggagatcctggcttccaacggagagatcggccagggactgcgtacaacgtttcctaaaatcgttgcaagagaattaaaccttccacttgataaggtttattacgatcatccggacactgcccgggtcccggactccggccctaccgttgcctcccgctccctcatggtagtgggggaactcctccgccgctgtgccattaagctgcgcacccaatggaaggatggagaagaccagatggtggaggagcggtttaaagaacctgattttgtcattcccttctacctggataaattccagggggatgcttatccaacctatgcctggggtgtcaatgcaatggaggtggaggtagatacttacacagggcttacaaagatccttggggcttacggaaactttgacgtaggcactcccattgactacaacattgtcatgggtcagatggaagggggattccttcagggaatcggttatgcctccaccgaatatatggactacgaccagaaaggaagaatacgaaacaattccttctctgattatttaatccccacttctgcggatgtgacaaacttaacatgtatgctccatgtagagaaataccctgacggaccttacggagccaaaggggccggagaacttcctctggtaggggttcctgccgcttatgtggaagcagtggagccattcttctggctgccgactttttcagggaaaagctggagatcccacttcctcctgctgccctgcacatgaacgaacacttcaagcgcattgatgccgcagaaaaagtaaacggaaccggaatctttgctgatgacatgtatttgcctggcatgctgtacgccaagtgcctgtattccaagtatcccagagccctgatcaaccggatcgacgtgtcaaaagcgctggagcacccggactgtgtggaaattctgacaaaaaaagatgttccatgtaataagatcggccatatcaagcaggactgggatgttctcatgggcgaaggagatatcacccgttacgtgggaaatgccctggcagtcatcgcagcggcccgtgcagaagccctggaagagatcctggctctcattgatgtggattatacccagcttccagccgtcaccagcccttatgaggctttaaagggagatgctcctcttattcatgaagacggcaatatcatgagccgggccaatctggtaaggggcaatgccgatgaagcaattaaaaattcaaaatatgtggtaacaaaaaaatacaaaaccacctggcaggagcacggcttcatggagccggagtgctgcgtggcacttcctgaaggggaagacggcttgttgatttatactaccagccagtccatttatgacgttcagagagaatgcgcccagatgctgggccttccaaaggaaaaggttcattgccatgctcctttagtaggcggcggcttcggcggcaaggaggatatgtctgtacagcagtatgctgccttaatggcctggtataccaaaaaacctgtcaagatcaaatacagccgtcaggaatctttaaattaccacgtaaaacgtcatccaatggaaatggaattcaccacagcctgtgacgaaaacggacggctgactgccatgaagggtgtgatcattgccgatacgggagcttatgcttctctgggcggtcctgtgctccaccgcgcctgtacccatgcagccggtccttataactatcagaacattgatatctttggcatgtccgtttataccaacaacgtggtttcaggtgctttccgaggatttggcgtaacccagagctgctttgcaacggaaatgaatatcaacctgctggcagaaatggctggtctggatccctgggaaatacggcggcgaaatgccatcaagccaggggatgtccttccaaacggacagactgcagatcccaataccaatatggaggcctgccttgatgctgtaaaggatatttattattccaatccatacgccggaattgcctgcggctttaaaaatgccggaaccggaatgggcaaaatggatgtaggccgtgtccttctttccattgagcagggaaaggttcatatccgtacctctgcctcctgtatgggccagggaatcggtcaaatggccttaccgaaatctgtcacacatccggtcttgatcctgccctctttgtctttgaagcagccgataccatacggactcctaactcaggaacctccactgcttcccgccagacggttgtcacaggtgaagccgcccgcagagccggcgaaaagctgaaatgcgccttagacagcgggaacagtctggcagatctggaaggacaggaattctttggagaatattctgcacaaacagacccattgggagctatcaaagataatccggtaagccacgtatcttattcctacggaactcaggtgattattttaaatgaagaaggaaaaatcaccaaggcagtatctgcctttgatgtaggaactcctgtaaacatccaatcagtggaaggccagattgagggcggtatgatcatggggattggctacggcgttacagaagagtttaaatgtgaaaacggatatcctgtaagtaaattcggtaccataggatttatgagggcagacgaggcacctgaactggaagtgattctctgccagccaaaggaagaggatagactgccttattcctttggtgccaaaggctgcggggaattgtgcatgatccccacctctcctgcctgtgctcacgcctactacaggctggatggcgtattcagacagagtctgccgttaaagggtacgtattatagaaagaataatgggatttcataatataaggttatgatttcaaggaacccctccccggtgtgagagacggatacagtctcacaacggggaggggttctattattgaagcagtaattttgcataaaaagcggtttgattctggttgaccatgatctttgcagcagtctgaagcttttcctgagcttcctgacttaatatcatggtttgaagagcaggttccatggaattgcctgcgcttatgtaagacatgccgcagggtaagattgtggtaacatgtttggcggtttcatagcagtctctcaaatatcttccaaagctttctccggacagtcctttcgtatctccctggatgaaacagccgcgtatggatatgaaacgcaattttctggcttctgcggataattgtgctaattcttccattctgaagcccggcagttttccactgtcataatcttccggaatcacggaaattcctatcacttctaaatgtcccggagccagatatccggctgcttcttcattgataagctccatctcttctaaactggatacaacgaatttacaggttccaatggctgcccgctctttataaagggcagtgaagtaaatgtcatttctgtccattccggccaaagaggacagacggacggagctgctgttttccgcctccaatgcccagccctttttaatgagatactttacagtttcatcattcaactcccctttgtagagatattgaaagccgggaatcagttccaggactgactgggctttttccatttgatcattcatatggtcttctccttatccattcatgttactttcagaatagcccatttagattatatttcaagttctttttccatggatatcggggcataggaaaatcctccggaacaatggtcaggaggatttccttgtgcttacataagtgatttataaagtttgatgatatcttccagactggcttccctggggtttcccggagcgcaggcatctgctgcagcggattctgccaggaactgcacatcctcttcttttgctatttgggtcaggtcggccggtatccctatatcggcagacagctttctcaccgcatctaccgccgctttgcggtattcctcctctgacatgttctcagttccttccacacccagtgactttgctatgtcacggaacttcacgcctgtgtttccggcattgaactccatgatggcaggaagaaggatggcattggcaatgccatgaggcgtgtcataaacagcgccaagtgcatgagccatggaatgcacgatgccaagaccgcagtttgaaaatcccattcctgtgatatactggcccaaagccattccttcccggccttccgcagtattttccaccgctcctcttaagcttttgcctattaattcaacagcctttaaattgaacatatctgtaatgggattggcaccctttgtgatataaccttcaatggcatgggtcaatgcatccatgcccgtggcagctgtcagaccttttggcatgctggacatcatatccggatccacaatggcgaccacagggatatcatgaggatctacacagacgaatttcctcttcttttccacatcagtgattacatagttaatggtaacttccgctgccgtacctgcggtggtaggaacagcgatgatggggatgcttggctttttggttggagctactccttccaggcttctcacatcttcgtattccggatttgctatgatgatgccgatggctttggccgtatccatggaagagccgccgccgaccgctatgatatagtctgcccctgacttcttaaaagcttctacccctgtctgtacattttctatggttggatttggtttaatatccgaataaacctcataatccagtccattttcttccagaatctttgtgatctttgaagttacgttaaatttaatcaaatccggatcagaggcaacaaatgccttctgaaaccctctcctgtttacctcccccggaatctcctgaaccgcaccggagccgtggtatgatgtttcatttaatacgattctgtttgccatgacaacctctccttctccttaattatggacatgctacttatgttacaatattaacaactaagggaaaaaaaataaagttacagtttgaagtttttgtaacaaattttacaaaagcttcaaactgtaacttttattatgtgcacatcgactataccctacatcaggccagcttctgaaaataccgcagcaagtctgggcggcatggcctccgtcaggcttgctgccatctcttccggagtctgcttcatgccagaaagcacccatttcaccgtcatatatacggaacctctgcaatacatctcaagaagaaactggatttcctcggaaagcagttcctgtctattccgggtaatgagctccgtgtaaaatcccatgaacagttcaaaatcatgctcctttaaagaattataatcatcggaacggaatgcctctgtaaagaatatcttctcttttatgatgaattcgtactttttcttcaggctttggcccacggttttttccactccgatctgagcaaaagattccattaccagcttatcaaaataccagttgatcagatcgtatttatccttaaaattgcggtaaaaggtttgtctggtcattccgcacccatccacaatgttctgcaccgtaatcttatccacgggctttgtcttcatgcaatcctttatggaatcagccagacggtattttgttttttcgcttttgcttggattttcagtcatgttccgctcctgccccgtatattcctgccaaggcagcggacaaagtcaagcatacttaaccttggcggctgcctgcagggtcagatcccccgcagaatactgcggagtatttgatttatgcctattttaccacaggtttcaaggtttgtgaacacagacttccaagggattttctgcccttctgcctgttaaagctttgtaatatccatggtgtatacggctcccccataagtataatagctccttaaatccactccatgaagaactccgtcaatttttaccacagccggaatatcccgttttatatattccaggcacatgcggttactgatgcagtaatcttccagaatggagtaaaactcttcttttgtacccggcttttcatttaagtctatgaccagggtatgccctgccttagccatattcagctggttggcagtgcgctttgcatataggtaattcagcgcccaccttccgaaaagaaggacagcatccgacaagatcatgtatcttaaataattcgggagaaattgggcgaggagcaacaaaatgaacaggaaaatgtaataccagtatacaaaagccatacccctaagccagctgagatccatttccggcagccgtttaaatagctgaagcaggcagcctgccgcaagataaatcagaaaaaacaggccaaggcggtccataacggtttccagctcctgtcttctggaaaaaagccaaagccccattaacccaccggcaaacaaaattgtccccaaatcaatcccggaaagcagaatttcccaaaaagcttctctttttccctcatttctattcataatgcctcacctccaaaatcctgtcttttacctcttttaaatattttctggaaatataagttacctggaaatttatcatggataccttcataagcccattcagcatggggtatatgtccttaccttatctatattcataatcacagacttggatatccggataaaattagacggaagaagccgctccagctcataaagcctctgattcgtctcataggtttcctccttcgtatggactacctgcttttcattaaccgtttcaatcaaacaaatttcgtgacttggcacccggcagagctttcctccctttgacacaacattgttactgaacggaacaaatcctgttccagatattccacaagacggtccattgcatcatcccgctcatggatggataaatgtgcagtttcttccgcctcgtggctgattgttttaatattgactttcatactgcttcctccttactgccagttcatcatatcacatttgaaccggtatttacagggtttatgggtaagtggctggtttgaaacggtaagaagcagacaccataaaaaaactgcaccatctgaaggattttggaaggtcaaaggatatggatcaatccattcccaccgttctcaaaaccgtcagacagtgcagctgacactgaaaatcgttatacatgagtgtatttccgatttaaaaaagccgactattttttcgaaaattctaaatatatttcacggtatttctccaataattttttctcatcaatttctgctgcaagacacccgatttccgtcactgcatttccgcctgtaacattaccaaaccggatacagtcatcaatatcaaatccataatacagtccatacataaatccggcggcaaaagcatcccctgcccctgtggaatcaatatgttttacaggaaacggcggaatcgtatacgtgtttccgtccttcttataaatacatccttcattgcccttttttacaatcggaatatgcagatactgtcccagaatattcagagcttcttctgctgtttttgtcccggtgattttttctgcctccatttcatttggtataaaataatccacataagggaaaacatcgcagtaccagtcaagactcatggtatcgttccatgccgaatccagcacaatgacagctcccgcttcctttagaggtctgcacaattccttttgttccaatgacaagtaagcaatcttacttcctttataaaactcatatactttctgattttccacaaaaaacgcatcatcagccgggcggtaagaaataataccccggtcctgttcacatgagaccacacagctaagcgtcacgggatcatactcgggagaagaaagcatgttggaataagtcagcttattcttctcaagctcttccacaaggtattggctcaagggtccttttcctatatacgtagccagttttacaggaacccccagctttgacaggagtaccaaggtagcaaccgggccgccccctagctgtcttgaacagcttccgctgtagatttcttctcccaggcggggcattctgggagagtttccaaaaataaaatccacattggcaatgccaaatcctgctactccagccatatccttcctcctgtatactcctgatatgcatcaaaataatcctttacaatcgacttagccagagaataggaggataccagcggatggagcatcaaagcatctgctgcttttccggcatcatgttccacaattgcctgcgctgctgttctctcataatatttcaccccgcagattaactgcctgacgctttccggcacctcataatctcctggttttggctttgccccttctttggagatatcgcacgaaacttctatgatgtcatcctttttaagccatggaagtgtttctccattgggcatgcataaaatcatttcgcccctttggccggtgatccttgcccgcatcagcgccagtgctacgcctgcatatccgccctcatcttcactatataaatcaaacttcggaatgctctgttcctctctggccacagaagtttctccctgcatgtaattgcactcccttaaaaaggtatagtggctgtagatctcaagcatcttgtcaaagtccttatcagcctcatacctgcccagttcctgaagcatcttatgattgatggcctgaattctttcacctcttgtctcactggttttttggatattttccaatgctttttcccggtaataaaaatagtataagtattcattgagcatacacccaaggtgcatggccagatccggatcaaaataacgcatatcagttctggtatataactcagggttttgcagaatctcatttatcatttcctttccctgctttttcacactggtaaagtaagataagtggtttaatccgatcaatctgacgcttaactccttcacattggttccatacagagctgcgatctgtcttaaaaatcctgacggcgcatcacagatcccatatacaaaatcatatccctggtctcttaatgcctgggtaaccaatccggctggatttgtaaaattaaaaacacagacatcctgactagcatacttttttatcagtttacaataatacagcaaagcaggaatggaacgaagcgccatgccaaagccgcctacccctgttgtttcctggccgatgacaccatgatttaaagcaatccgctcatccataatgcggctttcttcctttccaacccgaatggtggtaatgatgaaatccgctcccaggacagcctcctttggacctgttgtacagccgaatttcacttttggagcaatccgggcaaaagcttccttgaccatggccccaagaatatggactctcttctcgtcaatatccataaatacaacttctgttatgtgcagttcatctgcttgctgggccaggctctttgccagcatcaggctgcgggaaccgcaccctccgatcactgtcagcttcatactaatctccattccgccgctggtgccggcggcatttctttattctttgctgccctattagaaagcctgttttttaatcatactgctgatgctgtccacggtaatactttcactcaggaacagcccttccgcatatttcacacctgcagttcttccgtattcttccgcaagattcattgcatagggcagcaccttttgagaccggtgggcttcacaggactttttcttaatatcaataacatctgtgatatccacatagatatccggccttcttttgttccgcttgttatccgcaccaaaatatagaattgcttcataatgccaatccatatcatcctgggagtattttttcagcccagccgtaaagcaggctgcttttgtaatcttagatacagctacatggtccggatggtaatcctcttcaagaagggtcagaacatatcttggggaacagtctctaagatgggggatcaaagcatctaccgcgcttttttcaaagtaaacacctgcatccgggaaatccagcattacaaaatagtccagttccaatattttggcagcttcttctgcttccttctctcttacatcctgccgggcatatcccccgattctcctcttgtaaagatcaccagaccggtcttatacccttctttttttacttttgcaaatattcctgatgcgcatacttccaaatcatccggatgagcgcatactgctaacaaatcaatcatccttaacctccctactgcttcgctccagtggttgcaattccttctacaaattgcttctgaaaaataaagaaaaataaaatcatgggaagaattgcgataatacctcccgccataacctgtggataataggttgtatgttcaccgatcagcattgccaggccagcagacaatgtcattttattcatggaattattcacaatcagcggccacatcaaatccttaaatgtagaaattgccgttaaaatcgccagagacaccaaagcaagcttcataagcggcagcaaaattttgaaatagatctgaaaataattacatccgtccagcatggccgcctcgtccaggctctttggcaatcctttgaagaattcacgcagcataaaggttccaaatgcactgaacacctttggaagccataatgcggtcactgtatctgccagtttcagcttaaccatgatatcataattaggcactaaaaaaatttgtcccggaaccatcagcaaagccagcaggatgataaagatcacatccctgcccgggaaatctaatctggcaaaggcataggcagccatggaacagattgacagttctactgctatggtaaaaaacaacacaagaaatgtattcatataaaaataagcaaaaggaaacttatctaaaacctgccggtagctctgaacggtaaagacttccgggaatattgtaggcggtatcctgatactttcttcataatctttaaaggaagtcaatatcatccataaaaacggagcaaccgttacaattgtgcatatgatcaaaagcagatagaccggccatttctttttcattccatcacaccctctctttaatcatcataaaataccagtttcttttgtagaatcatttgtactgcagtaatgagaagtatcaataaaaacaacatgaaactgattgccgctccataacctttatggaacttaacaaatgactgctcaaagaaatatgtgaccagggaccgggaagcttctgttccgctgcttccctgaggaatcatcaggtaaataaagtcaaagatctgaaacacatttataaccgttgtcacacatacaaaaaagatggagggggacaaaaggggcaacgtgattttaaaaaactgctgcactgaattagccccgtcaatctgagctgcttcctgataactcacaggaatcccctgaagccctgccaaaagcacaattacctgataagcaacactggcccaaatgaacactgctgatatggaaaataagaccaccttaggatccgacagccaggccaccggatcaatgccaaacctgccgatcatttcattaaaaatgccaaacttataattcatcagccatttccataaaagaccgattgcagccggaagtgtaactgcaggcagaaaaatgaatacccggaataaatcaatgcccttcaccctgaaattcagcaatacagcaatccctaacgccaaaatcaccacaagaggaacacaaatcactacgtacaaaatggtattggcaaatgcccttataaatgcctggtcctgaaaaagccggcagtaattcgccagtccaacaaacttaggagttccaaagctggacttgttcgtaaaactatagtatacattctgaaaaaaagcaccgataaaaaatactgtaacgcctgccgtcaaagggaaaatcatcagatacccggtcagcatttcccggcgttttaaccgtccggaacttctctttttctttttcatcccataccctctcattcataatgcagaacttccttataagattctcctcatacggtgtgagcttcttccctttcggttcaatgcaatcctcttttttatgactcgctgtccaacacgctttgcattgctttttgaatctgctgacaaccttcttccggggttatttcttttgcaaaaattttacctgaaatttccgacaaagacggaagccagtctgcaacagtcagagaagtggggaaggggtatcctgtctttgctgcttcaaagataaccgctgcatcaatatgttttgtcttataatactgctgggcgcttaacaacgcaggtacatcgatttttgcctctgcctgaagcttgttggactcctctcctgccagatacttcaccagtttccatgcggcttctttttctttgcttttagaattaattgcgtatcccaaaccgccaataacactttgattgccattttcctttaaaggcatggcaatggttcctatttcttccccaaagctggcctcatcaagtacaggtactttccatgaacccatgaacagcattgcgcctttttgagacaggaataaatccgttcccttggtatcagataaaacttcattaccaggcattaaacctgcttcaatcagatccacgatatcctgatatgcttttattgtgcctgcctgatcaaatccggccgtttttttatcttcacttatgacaaatccgcctgtctgagagatgaaattaaagtaagaaggctgtggatccagttccatcaaaatcggatattcatcggaaccggcggcactgatcttatcctttaactgatcagcagtttccaccattttatcccacgtccagccctttgctggctcagccacattgtatttttcaaaaatggccttattataaaatacctggaccgtatcgattccttttggaaggcaatactgtctcccatcatactgcagggagtccgctacggtttttacataatgctccatatttacgccgtctttttctatgtactcatcaaggggctccagcactcctgcgcttgcatatttaggaagatacgtattcatccaaaacacatctgccgcattgtccgaacccatagccgcatccaattttgtccagtactgagaccatggcgtcagctgcagttccacatcaatgtccttattttccgcttcaaacttttctattatttcatcaaaaacaggtttctgaacttcatcccacaatgcaaacgtaattttagtttttttattttccttttctcccgtttccgttttcccgcttccccctgtattttggcaggcaactaatgaacccgccatgaaaactcccagcaccatacacaatatttttttcatgcttaacctccattatatttttattttacccgtgatcctcacttttcattttcattcatagttctctgcacgtgccgccttcctccagcttataaggcagtgttatttcaatgttttcctctttttcttttttctgaaatgtatccaaagtatgttcaaccatcattttaattggctgcttaatggttgtcagttttggggtcaccttctgtgaaatgctgatcccgtcaaaacctaatacagatatatctcccggtacatttaaattcgcctgatccagagcgctgatcacccccatggcggcatcatcactgaaagcgaatacagctgtgaattccagtccttcttttaatgcctgctgtgtcatgttaaaaccgctttcataggtcagctctccgcatttaatcatcttatccccaagctctaatccaaattcttcataagctcttttacagcccgtaattctctgaaatccggaactaatgcttttagggtgatcagacagtattaaaatatctttatgacgtaatttcagtaagtattttgccccccatgagccgctgccagatcattaatgtggaccatcttacatcttttatccgtacttatccctcctaacataactgtctttatattcttggcttctatgtagttcagcatatcctgatttaaatcctcttccagataaatcacacctgtaatgtccaaatccctgaaaaactgtttgtattcttctccgtcctttgaaacaggaaaaaacaccatccggtaaccgtatcctggaacttcttctaaaagtatttttaatacttcactgaaatacgcaagctttaaatttgtgagcagcacagctatcacaccgggattcttttgtttacttaccggagtataatccagctcatgggcagctgactctatttttctggctgcctcatctgtcacaatatttttcccgtgaaaatatcgtgaaacagttgcaggtgatacaccagctttccttgctacatctcgaatgttcacccccatttttatcgctcctttgttaatattgttttatttttttctgtttttttagtttttattataaaaatcatcttactacttgtcaatattgtttcatttgtttcactcctgtttcatttgtttcaggagttattcattataatcccaacatttctacatgaattgtcttaattatatttaagaagaactctttgagaattcctcgtcatttaattctgattcttatcttacacttttcatagttttatggtctttactccgtctctctgctcttggtctttcttacaggcagtcatgggcttatgaaacaatttctcctttcatattccaggattaatcatcacatctgatataagtaaaacttatgtcatatataaaaagcattaagtttaccaatatcaattatcatgttataataaagtgaaattaaaaaatatcccatcaatatttgtcatgggtttaaaggagaatcatgtatatggagagactaataggtactgtttcaagaggtgtacgcgctccaattatccgtcagggagacgacattgcagagatagttatttcaagtgtacttgatgcagcaaaatgtgagaattttgaattacgtgaccgagatgttatcgccgcaaccgaggccattgttgcccgtgctcagggtaattatgccactgttgaccagatcgcggcagatattaaaaataaatttggtaatgaaaccatcggtatcgtgttccctatattaagccgtaaccgtttttccatttgtctgaagggcattgcaagaggtgcaaaaaaaatcacattaatgttaagctatccttccgacgaagtaggcaatcacttaatcgatctggatgctttagatgaaaaaggcattaacccatggactgatattttaacagaagcaaagtaccgtgaactttttggctaccgtaagcacacctttacgggagttgattacattgaatactacaaggagcttatccagaaggaaggctgcgaagtggaagttatccttgcaaacgactgccgtaccatcttaaattatacaaaacatgtacttagctgcgatattcattcccggttcagaacgaaacgtctgttaaaggccgccggtgcagagtctgtatatggccttgatgatgtcttaaccgtttcggttgacggcagtgggtataacgaaaattatggcttgcttggcagcaataaagctaccgaagatactgttaagctgttcccccggaactgcgaaccaattgttaagaagattcaggatggcttccttgaaagaaccggaaaacatgtggaagttatggtttacggtgacggtgctttcaaagatcctatggggaaaatctgggaattggcagatcccgtagtttctccggcatatacggaaggactggaaggccagcccaatgaagtcaaattaaaatatcttgctgataatgattttgctgatttaagcggagcagaactaaaggctgccatttccaattatattcaaagtaaagagagcaatttagtgggcagcatggtatctcagggaaccactccccgccggttaaccgacttgatcggatccctttgcgatcttacttcaggcagcggtgataaaggaactcccatcgtattggtacaaggttactttgataattacaccaaataaatcagtaagtatgttttattttttgtatcctggaatttttacctttctatcaaaaccgattaaaaaattataaaataaagaacggcaatggcttttaaccattgccgttctttattttggatccttgtaagtaaaatcatctttgctttgccctgacaaactctattgcttctttaccggttatatgttcaacatcgattgcaatgatgtaagcctgtgtacatccggctatttccttgtgtctggcatcctccggctgatcaccggaatacttttccaccagggccatgaatgcctccagccgttcatccccctccacaattccggcttttccaaaggcaataacgctgcgaaagtgagaagtatattctttactgacaatggtatcttcatcaattatggaaaaggataccttggggtctttggcgatagcatcgattttatgtccggcttttgctgaatggaaatagatttttccattcaaatatacatagcttaaggggactgcataagggtagccttcatctcccatgcatgccaaaacaccatttgtgcatcggtccaataccgcttttgtatcctcaggtgataataattgtttgtttcttctcatttctctaaacattccgtactcctctctttccttgaaacacatttctgctgaatcatatgatttaattatagcaaagattgtcaatagcctcatatcccggctgtcacgtcaatggggtattcccaatgaccaagggtcacagcgcaccccgcaccatggggcggaccctctgcattgctgcttgatgaggtaaaattgagatctccactacagaaaaattatcagcagcttcaaaaaaaagatctggatgccatgaatcagtcattagctcccaatccaggaaaagatatactgcacctgttcctgactttggatttcgggtttttcaagcttttgaaaagttccttccattcccttttccaatgcggccagatggaagtggcagacggctatgcctatgtccaccctttgaaggtcattttttacattgtcgttttttaaagttcttgccagataaaaatggtacgtgtctttatcctgcacaattctccagggctgcttattggcagcagaaggtgccagccgtaccatttccagcggaaaagcatactcccctgcctcggcctttgtgagcggctgtgagaaatcctgtttaaaaaacagttcgctccattcttttctctgatcggactttgacgcccacctcatcaacgattccagcgttctttttttacctataggatatccgataggggaaatgcaggggaaaaggtccccttctttcagattcatggccgcgccaaagctgctgcggttaaaggtcccgccaatccagcaggtgccaagcccaagggatgcggcatacagaaccagcttttcaaaggaatagcccagcgcttccaaagccagatccctgtccgccaccgatgcgccgataaagttccccgcaccttttatgaccccataggttcccagcttttccccatcggatgatgttgccttttccagaaggcgaaaggtaacatctacggaaaaaggattggataaatgatccatgtatgtgttgattttatctttatcatcttttgaaagaccacggttctcataagtacggatgctgctgcgaaccttgaccgtttcctcaacagggaaatccattttcatattttactgctcctctctttttcagactaatgtcttataaagattgatttcaccgggtttttctacgaaatctgcaaataaagaggcggcttctttaaaatgctttgcctccatatgtttgttcagcgattccagatcttcccattcctcaagcatggtcagcagatgagtgttttttatgtcctgaatcagctcataacgtatgcagccagcgtcgttctgccgggtatcctgtaccagctgttttgctgctgatataaactcatctaatttttctgctttgatgtgattctttgcaacgacttttatcattagtttattagctctcctttgctgtttgtctccaattttcgtaatgcactctgtccgccttataacggtcaataaattcatttttctgcccatcaggataaccaatggaaatcagggcaaaggcctgatatgatccggaagctcaaacaggcggctcacattttctgcaacagcatcggacgtggcaaccccaagccatacacctccaagtcccagatgaacggcttctaaaagcatattttgtgctgcagcacccatatcctgctcccatccggccggcacgatcagttctttatcattggccagtaaaacaaaggttacggcagaattggctgccagctttgcataaggtgaggtttcagcaagctgagccagtttttccttatcctgtaccacaataaattcccacggctgctgattggcagccgatggagcctgcatggccgcgtggagcagcttatcaattttttcaggctccacctcctgagctttaaactttcgaatgcttcttctgataaaaatttcttccatagacatgacctcctgtattatgatctttattttttatcgtccagacttttaagaagcttgctgctgatttctataaatctggaggtttcttcttctgtcaatacatcctcgtacttgccttgaagcatattccacgctgttataatatcactttgcagtgccaggccttctggcgtcgtacaaagatatacattctttccttccgatttctttacaataaactcatttcgctcaagccgctcaagcagacgggttatggtagaaggtgtcaaatgcagtgtttcaccaatttccttctgaggtatgccgcctcttaagtttactatatacaggagtattgcatggcttggggataaccctgttttgcggaaggcttcatccgcaattcttcccaattcccgggccagttttgtggaagtaaaaaacaggcagccattaagcttacattcctgatcctttgtctcgaaattgcaatccaaaataatacctcctttgtttgtacatacaaatatatcatttctttggtgcgccgtcaagtgtaagtttacagcattgccctccatgggggtggaccctccgcttcgctgcttgatgaggtaaaaaaaacagggtattttgccgccgcccttacggtaaacggcaaaataccctgttatcttattcccaaagcacaatctccctcaaagaaagagattcctgcactttaatgatccgctgattggatgatcctctaaaccgcagccttagattctttttctccacttcaaactttccgtctaccagaacatccagacaggctaaaatcctctttgtctccggaagcctttcccccatgtctcccaggatatccttttcaaaatcatatccagtgtaacaccagatcgtcttttccggaaactgttcctttaccttctccaccagaggcagaatccctttctggtttgccgggtccatgggttcacctcccagaaggcttaaaccggcaatgtaggtatggtccaaatatcccagtatcttttctgtaatttccggcccgtattcctggccgtaatggaaatcccaggcttctgaattaaagcattccctgcaccggtgattgcacccgctgacaaacaaggacaccctgactcccggaccgtttgctacatctgtaggctttatggtggcataattcatggcatgcctcctacagatgaaggactctggatttgatctcctttgtctttccggtgttccagaagttttctcctaagtatccgcaggttcttctggtcacattcatccgcttcttgtctttgttatggcactgagggcattcccattccatgtcgtcgttgatgatgatctccccgtcaaagccgcattcctgacaataatctgatttggtgttaaattctgcatactggatgttatcgaaaatgaattttaccacttcttccattgcttctaaattgttctgcatgttgggaacctccacataggagatggccccgccggaagaaatctcctggaactggctttcaaaattgaatttgctgaacgcatcaatggattcccgcacatcaacgtgataggagttggtgtaatatcctttatccgtgacatccggtatgataccgaaacgctcccggtcgatttttgcaaaccggtagcaaagagattctgcaggcgtcccgtataagccaaagccaagaccggtctgctctttccactggtcaacagcatttttcatatagttcatgacgcgaagggcgaattcttctccttccggagccgtatgactgacccccttcatgagctttgtcatctcataaaggccaatgtatcctaaggaaatggtggaatagccgtcgcgaagcaggggatcgatcttttctccctttttaagccttgcaatggcaccatactgccaatgaatggggctcacgtcggaaatagttccttccagagacttatgcctgcacatcagggcttcgtagcacagacttaagcggtcatccaaaagcttccagaacgtattctcatctcctttagccagaattccgatctggggcaggtttaagcttaccacaccctgattgaatcttccttcaaacttgtaattaccgttctcatccttccaggtagacagaaagcttctgcagcccatacagctgaatacatttccttcgtaattctcccgcattttttttgcggaaatgtaatccggatacatacgcttggaggagcatttcactgccagcttggttatataatcgtattttccgccttttaagcagttgttctcatcaagcacatatatcagcttggggaaggcaggcgtgacataagctcccgcttcgttcttgattccttccagcctctggcggaggacttcctccacgatcatggcattctccctgatgtattcatccttttcatcaaggtataaaaacagagtgacaaaaggtgcctgtccgttggtcgtcattaaggtattgatctggtattgaatggtctggacgccggatttcagctcgtctcttaaacggatggccgccatcttctccaccatttccccagtgaccgtatctccgaattcttcacggatctggttatggaatttatcattgctttttctcaagtattttcccagatgccggatatccacagactgaccgccgtactgattgctggcaacagccgcaatgatctgggtcatgacggtacatgccacctgaaagcttctggggctttcgatcatcttttcgttcataacggtgccgttatccagcatgtcaccgatattgatcagacagcagttaaaaatcggctgcacgaaataatccgcatcatggaaatgaattgctccctgttcatgggcaagggaaatcctctcgggaaggagcatcctctttgtcagatccctggacacttctcccgcaatataatccctctgagtggaagccagtatggtattcttgttggaattttcctctgccagctccttgttttcgttcttgatcagcttgagaatggactcatccgttgtattcgctttcctaagaagcgctctctggtaacggtatatgatatacttcttggaaagtgtgtatttatttttatttacaagaccgatctcaatcatatcctgaatggtctcaacgttgatcacatcctccacgcggctctccacataatccagtatcccatcgatcatttcctcaccggcctgctcacatgcttccacttctgcatttgccttccggatagccgtaacgatcttttctctgtcatactctacaattctgccgtctcgcttttgaaccttaatcattcctgtcacctttacctcttctatattttgtgtcttatgtattggtatcactatatctagtgctttttttattatacactatgaaaagaaaaagtaaaggggattttttccttgttaccggataaaatttgttctgggaatttcttccctggctggaaagctgattcctgcggcttttcccacctccaggcattttaacagccatgccatatttttgccgagagtcctcatggtatgaagcccttccaaatcctgctccacctcctgaggggtaaatccgtgtaccatgttccagtaagaggaagaaactaccggcatctgtgcgatggtaaaatatttgtttaaaacatcaagagatgcggtggttcctgccctcctggcggatacaacggctgccccgggcttaaaggcaaaattccttcccgcataaaacaaacggtccaggaaggaaaccacagtgccgttaggggaagcatagtgaaccggggagcctacgaccagtcctgcagctgtttccatttcctccagcacctggttgaccatatcataagtaaatacgcaccttcctgtttctgaacacttttgacaggcaatgcagccatggacagactggctccctacatggaaaatttctgtctcaatgccctcctcattcaacgccctttccacctcaagaagggcgcggttggtacagcctctctcatgagggcttccgtttaacatcagcactttcatcactcatccatcctttctttcttatcatttatagaaatgcattcatttttaaatgcagtttctctaaatatccaaaagccccagcagatcctctttggtcagattgcttagagatacggttccttccgttataatctgttccgccagatccttcttagattcctgaagctttaaaatattttcctcaatggtgccttttgtgatcagtttgaatacgctcacctgcttctcctgaccgatccggtgagcccggtccgttgcctggttctgagccgccacattccaccatgggtcaaagtgtatgaccacatcggcagcagtcaggttaaggcctgtgccccctgctttgagggaaatgagaaacaggggaaccttatcatctttaaaggaattcaccatatggagcctctcctccttgggagttgaccctgtcagcatgtagtaagaaaaagcttcttttttcagcctttgttcgatgatatccagcatggaagtaaactgggaaaagagcaggatcttatggcctccctccacaccgttgcggattaaatccatgcaggtttccagctttgccgattcccctttgtaattctcatagcataaatggggatcgcagcagatctgcctgagcctggtaagcgccgaaaggatctgaatgttatcctttcccgatctgccttccagacgttcaagctcctgctttaagcggaatgcatttgccgcatacagctccttttgttccttgtcaaaggcagaatacacagttgtttccagcttatccggcagctcttttaacacatccttcttaagccgccttaaaaggaagggaccgatcaggcggtgaaggctttccagcaccgttttttcctgatccctgacaatgggcagctcatactcttttttaaatttccggtagttgaacagaaatccaggcataaggaaatcgaaaatgctccacagctcggacagacggttttcaatgggagtaccggtcaatgcaaaccggttctttgcatcaatgttctttaccgctctggcgctctgagtggacgcatttttaatgtactgggcctcatcaatgatctgaaaccggaaggacctgcttttgtaaagatcaacatcccgtttcagaagatcataggaagtgatcagcacatcttgttcatccccatggtttaacagttcttcccgttccccggccatgccggtgactgtcaccactttaagggaaggggcaaagatacggaactcattttcccagttatacaccagggaggccggacagacgatgagggaggtggtatgctccttttttcctgcttcatcaagaagcagggcaatgacctgaatagtctttccaagtcccatgtcatcggccaggattcctccaaaaccatagctgtccagggttttaagccagcggtatcccgtcttttgatatcctctcagcacatggcggagaggctggggaatttcaaaatcgctgtcctcaacagacttcattcctctgaccacggctttataaagctggtctctgtaaagggttatgccgtttccttctttcaaaagactgtctaaataaagggctctgtattttggaaggcgaaaagacttgttcagcgctcccggatctgcggacaaaccctccaccagttttgcaaccgttaaaagtccattatcgtcaagactaataaactccccgctttttaaccggtaatacttttttttctggctgtaaacctccaaaagcctggtcaaatcctctcctgacaaaccgtcagtatccacactcagctccagccagtttcccgtgctccgtactccgatggataccttgggaggcggcaggatctttaatttcttaaaggattcggaaaaatacacctctcccaatgacatgaactcactgatgcctgaacttaacagccggtataccgcttcctcatcatcccggatggcaggatattctgattcatattccttgtatttaaaatacctggttattaagcggctgatgcggaactctcccggtatatcccggcatacggtacggggaaggcgttcatcctctaccggctggaaagaataatctccataagaaagggtcggccttagaaccagctcgtcaggcccgtcagaatcaaaatcaaaccgggctttcagctcatccggtttatagttctccagatccacttccctggagtcaatggtgcaataggcggcgatcctctttaaaaccctctcgtaaaaaagaggcatatccttgttgttgatttccgtttcataggaggctttatacccttccatcatctgcttgagaaacacggaaagagcctcactgcaggactggtcacagcaatataagtactttgtatctgcaagatagaaacggtgttcgccttcaaaggccagtaaatcccggtcaatggacaccaataccccttcacgtccctggcgctttaccacgaccgttaaatcaggatttcggtccaccaccgcaagctgccgcttctgtcccttgtaatcctcaatttccagggtcttccccatcatgatcctaaaaaaacggtcccggtttgcccggcttaaattcaaaaaccgcaggacaggttttgtggaaaaagaacttttctgaaactgctcataatgttcacagtaagaatccacgatctccagaacgaattccaaaagaggacggctttcctttacaaaggcagaaggactgtgatggaatgccagatttttaccgtactccacatatgtgccgttctccaccgcatttgcaaaggaagctaaatccttgaccatgtagagccggtctcttcccagcttaaactccagcttcacttccctgcggctgaccagaagggacaggtcaagctttacctgctcttcttccccctcgcccatgatgcgggatacctccctgttggtatattcccggatcatggctcttgcctgctgggaggtggctaccggccttccctgattttccgattcctgctctttataagcttctaacagggccatgcaatgggggcacatgccccggtaggaatttccctgagcacaggaacaagagtagtcaaaaacctgactacccttgatatgcagacttgccctatattcctttccctggtcctctaccagggccctgacgcctgattcgcccttccaaaaggtatttgtcgtcaagtgtgatactttcatagttcctcacatccgttcaccatttacattcgttccggcgcctcaattcccaatacgccgatgcaagcattcaatacatccttggcaagcctgatcagacggatccaggatgcctgccgctctttattctcttcagatatgatctttgtatcatgataaaaacggttaaaggcattggcaagctcataaatgtactggcatatcttatggggtgcaagctccccaaaacttgtttccataatttcattgtatctggaaagctgaagcatcagatctttttccgcctccgttgcagcagcaagaatcttctcttctccctggtacttatcttcaagaccctggtactttgccagaatggacttgatccttacaatggtataaaggatgtaagggccggtgtttccttcaaaggatacaaaacggtccatatcaaacacatagtcctttgaggcctgattggatagatccccatactttaaggccgccattccaacgatctttgatgtttcttctgcttctgcctcagaaacggtacggttctccatgatcttttcataagcagcctggctgatgtctgatatgagggtttccagacgcatgacgcccccatcccttgtcttaaagggctttccgtcctttccgttcatggtaccgaagcaaagatgggacatcttcttatcctgtgacacaaagccggcctttttcgccacacggaatacctgaataaaatgaagttcctggcgcttatctgtgatatagatataccagtcaggccttatctctttttcccgctcaatgatggttccaagatcagatgtggaataaagggccgcaccgtcggattttcttacgatacaaggcggaagttctttggaatctccctcttctccaatatccactacaagggctccctggctttcataagcaagtcccttgtcctccagctctttaatcaaatctgtaatatagggttccgcatcgctttcccctttccataaatcaaaggaaacattgagatttccatagtttttctttaaatctgtcacagatacttctataatatgctgccagatggcgcggtaaggcttaaaaccgttttgaagctttaaagtggcgtcatgggctcttgtgctgaatccctcatcagacttggcttttgcactggccgccggatagatttcctccagctcgctgatggtaaagggcgcttcctttggatactctccttcataggattcatcaaaatagggaagctccggctttctgtccttaagctcctcaatgatcagccccatttggaggccccagtcgccaagatgaacatctccgatgacatgatgtccaagaaaacggcccagcctcttaatgctttccccgataatagcagagcggagatggcctacgtgcagcggttttgccacattggcgccgccgtaatccaccacgatcgttttgggatcttccgttttttcacaaccgcactgctcttcaccggccatgccattcatatattctgcaagataatccgaatcaagttttaaattgataaatcccggcatcaccgcatccactgcggcaaatatacggctggccgcaagctttgccaccacttccgttgcaatatcaaacggtttctttttataagccttggcagctgccatagctccgttgcactggtattcgcaaagatccgggcggttggataaggtcacctttgcataagcctcatcgtatccgcagtccgcaaacgctgccttcatctctgccgtaatcaaatcaagaatcttcttcatcggtccctggtctcctttttctattccagatatttctaagctaaatactaattatattacaactgatcttaaaaatcaaattcttttactggatcgtacaaatttacctcagaggtcaaatagagaaacatattttctcatttcaataaaataagctcctttttaagttatggggcggacaatcctcactttttccaaaaaggagcgttcttttatgtattacacatacctggcacaacacagcaaaaaagaccgggcagcccggtccttttctttctgattaaactctggacaggtattcacctgtacgtgtatcaatcttaatcttatcaccctgatcaacaaataatggaacgtataccactgcaccggtttcaaccgtagctggcttggtcgcgccctgggcagtatcgcccttaaatcccggctctgtatctgtaatgaccagttccacaaataacggaggctctacggagtacaccttaccattataagagcataccttaaccgtctcattctctttcacaaactttaacgcatcaccgattacatccggcgctagtgctacctgctcataggtattggtgtccataaagttatgaagatcgccatcggcatacagatactgcatgtctaatctgtcgattcttgcctgtgggaacttttctgtcgggcggaatgtgcgctctacaacgccaccgtttaccacatctttaatcttagttcttacgaacgcagcaccctttccaggttttacatgctggaactccataatctgatatacagtaccctcgatctccaatgtgataccgtttctaaaatcacccgctgatatcataaatgatattcctccttgaatttctcttcttaaccttttatattctatactataacaaacacattttcaaccgttttttacaaatatctcccttttctttgaatcaaagggcttattttcctgttaaaaaatccattgccagagcgtatcctttaagccccagcccaactacctgtcccgtacaaacgggagcagtcactgatgtatggcggaactcctcccttttatggacattggatatatggacttcaaccttgggaatctctacagaacccagcgcatctctaacggcatagctgtaatgggtaaaggctccgggattgatgatgatcccttctgtcccgttgtgatatgcctcctgaatcttatcgatgattccgccttcataattactctgatagacctccagttcatggccttctctccgggctttttcctccagcatggataccagagcatgataatcctctgttccgtatattcccttttcccgtatccctaaaaaattcagattcggcccgtttaaaacaagaattttcatatcctcctaccgccttttctgcccacacgttttttgcgaaaagatatctcccaaaggcatgtccggcagtttctttctaatgtccgcaaatcaggggctcgtttgtaatatcctgtatgttttggatcagccggcttgtccggaccgtttcatccgtattataaccggttgaggggtcttttacccgccggaaatattcccacttttgatgcccatcatttttgttttttcttatccctgtggtaaaaatacagtacgactgcttctaaaactcgttttaaaacgatctggatttcttcctttggatgaatcggtttaaccaggatgctgtggattcctgctctctttgcaccataaacatcggtgaaaagctggtctcctacaaacaccgtccgttttacgtccgtacccattaattccatggcccttaagtatcctcttcgccccggcttgtttcctttataaatgtagcggggacttcccgcagccctggcaaaggcagctactctcggctccttgttattggaaagaaggcaggtttccatcccaagctcatgcagccgtaaaaacagcttcttagccctttcatccgcaggtgcgtcatgaggtaccagagtattgtcaatatcaaaaataacgcctcttatcccgctcttatataacttttcaaaaggtatgtcatatgcagaagccgcgtcttcatccggataaaatattctaagcataaatctcctacttctttaacagttttcctatttcttccataaacgtattcacgtctttaaattcccggtatacggaagcaaagcgcacataagctacctcatccacttcctgcagctttttcataacaagctctccgatcaccgtgctttccacttccttttcctcccggttaaatacctgggtttctatctcatctaccatggaatcaatctgctgtgatgataccggacgtttatggcaggaatgaagaattcctgattctatttttgaacggtcgtaaacctctctggaattatcttttttaattaccatgagaggcatggtctccagcttctcataggtagtaaaccgttttccgcatttctcacactgtctgcggcgtctgatggaactgttgtcgtctgccggtctggaatcaatgacctttgtatctgcttcattgcaaaatgggcatttcacgttttgggtcctcctgtctcacggactgtaatttcattggcataatttacttcatgaaagcaaataccaatcaaacttctttatagtatatatatcataacgtacaatcctcagatccgcaagcccatcctccttatatcccgcatttttccgttgctttatccaaatccacatttacaaggatgatatccggaccaacctgcctgatgtcacagaaggggatcacatattccctttccctgaccaaaaatccgcaaaagcaacctggcccaggcacaataatggctaaaaggcaacctgtttccatgtcaaaatccacatcaccaacatagcccagacgtctgcagtcacagatgttaattacttctttttgtttcagatcattaacactaaattgatatcagtgaatacactgtacattattattggaattaaatagcaatttaaacgctatgcaatttccccttgtttacatgggtaaaatcactggaaatttaagccgtcttgacataaacccaggctattacgctatagatgccgctagcacaatatcaggtgcgccagaagggacatcatacacgggatttatacagttgcctgtcgcagcatacagaacacagattattttgggttttgccgataacgggataaaagtcaggcaatacgttggaaatccggcagcttggttttcatggaaatgatcatttaggcctttttccacatacaatacacattcaagtcttgactggatatggtagaccctgacaagttcgtaaccactattgtttgacggtaaatatgctttattataatgctttgtgtactcgccccgggtaatgcgaacatggtggatactaataagtatcctgttttatctggtattacaaattgcgcacttgcgcccgtagccagtgacgatatggtaaatggtacggtactgtccgtaaatttattttctaaattgctatttatttgtgagaataattccgatgaacgaatagtaatactactaattctccttgcaatgaatatagtacccgccacgaatcatagaaacttcagcaatataaggtatatcattaaggtgaaaagttataggcttttgtgtatttataaaaactagtttctctccagttgattttgcatacttttctatgcatgaacagattacttttgtagatggatatgttaacgactcttctaaatcaatatgaaaaccttttttaaacataaaagctcctttcagtgaattattctcacatattgattatacaaaactataggaataagtcaaataatgcaattaagatttaactgatttatcgtacattgaaaacttaatattgatagttagtaggtatggtgatattctactcataagtatttatttcaaaaacattgggggagtcgaaatgaaagtgggagaagtatgtttattgacaaatgatgttatccgattatcaaatttttataaaatattatttgatatcgataatggcagtgacgataataatcaccaatttatcatatcggaggatacaacactgactgtttataatgacgggatagagcgagatgcgaacctacataacatctgtattgcttttacagttgatgatgtagatgtagagtttaagagattaaaagcacttggtatccaaattattgaaccaccaaccgtaagaccgtggggggcaaggaatatgagctttttagaccccgataataatttgataatttttaggtgttttccccaaaaatagaacgataagcaaaaaattaaatacgagaaaactactaactatcagtattaagctggtagtttttttgtactcagaatgaagcggtttaatacagaactgatatttatgaatgtctaaataaaaaaggccatagtctatccacatatgacagtctatggcctttagatcttaaactggtaatggcgatttaccagtcatgttatattttttattccaactatcttctgtacttttccatacatcttgttgaccaattttagctttaatatctgcattctccaatgcttttgccacaataggtgccatagtatttgccatcttctcataatcaatgattccggataatgctgcattcaactctgcagatataccggccttaaaatcataagaaggggtatcgtaggaaacagaggcttttgtatctaccatgtcaaagaattccctgctgacttgtacgttggtatctattgatggcagagatatatcataatctgtcagtttgtcagcaaaagaacctacttttgaatatatgacaccaaatttatctataataccattcattagtcctacagtaaagtagtcaccaatctgaaacgccttttttgacggtgagtgctcatcaaatccttttttaaacccatctattacaccttgggcaaaagtagcaatgccagttcctaaccagtccgtcaaattcgtaatgccttcccatagacctttaatgacgttttcacccacagtaatcattttcttcggtaattctccaaaaaactctattaccttgtcaatgatagttgggacctctgtcttaaagtatgatatggtattggtagaccatgtagatattttctcttttatttttattatcgtatcatatatcttacccggcatttcagagaaccatttcacagtgccggcaattacttctgatactttctggttaaatacattgtaagtttcagtcccccatgttgcaactttggttataaatgtagaaattccagaatagattttccctggcatctctgaaaaccatttcaccacagaagctataatttcaggtattttctttgataaataggtgaataaatccactccccatcttgtcacagttcctaaagcatatcctaacgcatatccaagcttctccggcaattcgttaaaccaatcagcgatatcttcaatgacactgcccactttttctggcaggccagtcaaatattcgataaaaccatcccacttacttgaagcagtagtttttacaagttcccatacagaggaaagcttttctggaatagattcaaaaaacggaattacagtatcattccaccacgccggaactgtctgcgtccaaaactcttttatttcatcccaatgagtgaccgtgtaaacgactccagctactactgctgccacagccgcaactacaagagcaccagccgcagctacacttatcccaagtgctgacgcaagggcaacaactccgcttactatggctgttcctaacccacttattgctccaactattaatccaggtattgttgttgtaaaaaatgtctttatgggaacccaaattaaccccattaatacagacggcaaagaagcccctgtttcagccatagttgtagttatcgtggttataatggcactgcttggaaatgccttggccagtaatttcccaataccggaaaaagtcaatcctttactgatagaagtcattatctttgcagacagtaactttccaagccccgtaaattgtaaaagtccaaaagtcgtaagaattgttgtttcaactggtgctgcactaaaagatcctttccagagatcaattccagctcctatagctttccatatggcttctcctactttgccaccgatttcaagaaaatcaatggattcaaggaatgtacctatcttaatccctattagagaccaatctgtattatccagtgctgctattaatgcgtctaatagacctttggcccagacatttaaagtggacccggcagaggcaaaatcaaacgtagtaaagaaattgttaatcccactggcaattgaattgcccaggttcgtccagtcaaaggctattccaaaagcaagtgccgcgtacaaggcagtatttaaagccccggcaatcgtcttacctacagctccaaacagttctggtgtaataaggccgttaaagaactctgcaagccctgtaccgaagccactggcaatagaataaacagccggccagtttatgttttctaatgctccggtcaaaccatcgctaatatatttgcctatgccaaaataatcaccagacttgaacgcatttacaatcctgtctgccatagcctgtgcattgttttccacattagcaaaagcaacatcccatgctttctggtattcagaaaacgcgtccaggaaagcgtcatctaaaagattgccccctgctccgccggaacctccagaaccaccacttccagcattacctgagcttacaacattcaaatcatcaaacccctgaaggttatcggccatcttctttgtgttctttgcggcatcacctgtgctgtctgcaatgccgtcagctgcgtcctccatgccacttaaatctgtagccgccgaaccaatagaagaactaaaatctccaaccttgattcctagaagacctcctatccatgaaaataaccgctgtacagctattaccaaggcattaatataaggaagtactttcgcaacaataggcaggaacaagttgcctatcgtccttgcaaggtttgcaaaattagattgcagaagtcgtaactgattcgagggcgcatcaagtgtatttgccaagtctccccaggcgtaacgggtggaatccagtaatataattcctctcaataatgccttatcctgctgatttaaagcagttatttttgcattaataccgagatcagataatttctcttgtagatttacattacgaatattaacaccgtatttatctagagtccgactcataccgaccatgccggaagccatatcttcccatacatcttcaaacttcatatttcgtacagatgcaaggtcagctcctatcatagatagagcgtttgatagctgcagggccgtttcagaggcaacacccatagaggaagccatctgtccaaaagtagcttgataattcataagcctttctggatcaataccaagactaactgcgccggtagatttcaaattcccattctcatctgccatgaagccggacattttcccagttaactcctgtgcacgtttactaaatgaagcggcataagcttctgctgattcatagccgaacttctcccaactttttactccagcgtcggcaacttgtccccacgcggcatcgaaatagtttagggtttctatgtaatccatagatgattctgtggctttccataggcttttcattcctcgaattatcatgaaccatttcgcataaaacaggccaatctgagaaacgagtccttttgtgcttttccctgcccttcctgcacttcgagaataagtatttagaccgtttaccattgcgcgacttgcacttgataccttagaaccattggaagccaagttggccagtgcattggtcattaggataaggttttggctaaccactggtgcacgggataatgttgccatcaactgtgacaaggctgtgcctaattgctgaatatttggtatagccgctgtagctgtctttcctcctagttttgttattgaagaaacgagatttgccagcccacttgtatcaaaactgagcgcacctatcccgttcatgccacttacaaaccttaaaagctgatctttaattggcttaaggtttgctgcggcctgtgtggcctttgtgccgccaagacggctaatattgtttacaagattattcagtccctcgatattaaacgaaacactaccaacggaattcatactggatacaaaactgtgcagagaagttgaaatctgtggaaggttctgtactgcctgtgtggcatttacaccacctaatctgcttattgaggataccagtttatagagagaatccggattaaagttcagactaccaacattgttcattccagaaacaaaatcggccatactggtttttaaaaactccagattctgcgttgcttccgtgaccgaagcacgtcccagctttgaaatggaatttgcaacattagtcagagtttccgtatcaaatttaagatttccaataccatttatactatttgaaaagctttccatagcgtgagccgtattgcttactccttgaacatcaaccgccgccagtttattaaggccactggtcactctggaaaaatccgcagttttagtccgctcattaaagccttggatagatgaagcaatctgatttattccagaggccacctgactcgctccggacatttctatcccggataaagcagattgcaggctcaacatcttttgtatgaatttgtctattttagcgtcagcactggtcgtactggcatctatttggactttcagatcgtcaattacatcagccatggtttcaccgccctttacacatacaaaaaaaggcgagtgaattttcgtccatcactcgcccttctttttacgtttcatatcattttccattgttccagcagcaaaaatgaagccttgtaaggctttttcactttctgaccgcttttcctcttctgtctttggtgttacacgtatcggttcttcaaaatacttacctttccgctttcttttaataaatggcattgcattacatacagtagcgtccaaagctgaagcaacatactggcccatgagccacatttcgtcactacgttgttgccgctttcttcgaaaggcctctacaaatggcagaagcttccgaggatttaaccgccagaataaatcatacggaactcccatatttaatgcttctggcaaatactgttcccagattattttgtggaagttgatttccttttgtgatcctgtggaatcttcccggatttggacttctgttcttccgccgcttcgctcatctgagcaattaccttgtccattccggtgagtttgaaaaaaccatcttcttccatgcagtctctcaggaaatcatacattccccagaatgaagcacactcatcatctggattctccttgacaaactgcttaaatagggctttggctgcctgttcgttttccaccggattgttttccagcaagccggcataaagagccgtaacagcgattttgggaatgtctgaaaccatatcagatgttccattcaaaatggccgttgcaacggatatcttttcattctcatcagttggaccattcttcataatgtaactgccagaaatgactttaaatatactgtccacacaatctttatactctgcagcttcaaaggaaaattccactttatagtccttaccgccaatcgttaaaatcctcatattttaatacctcccatacttatttattaaggttcttccgaaggttcagttggtacaataggatcatcccacccgatttctccggttggcgtaacagatacactggtatcccaagcattgtcaacgtcggaagccgcccaacctaatcttgctggcacgcaagtaaagtaaaaagcctttgtcagtctcgggtgataaaactccagccacatacgcttatttgattcttgagccgtatcgtactcatcacaaagatcttcccacatatccaggaacacctgcgacataccaaacgtgattgcaagagctccgcccggatctttcagtccatcaatataccgtttccagatggtatcgtttaaagatgttacatcatagctgcccacttccggattaaagtcagggatacttttgggattcggcagatcagtaaaggctgtgggctttgttccagctgttgtttcgatcccatatccgacatggataccagcagttgataaatctacagcttttgccataggtcatatcctcctttttgcataaaaaagaacctcgccattagacgaagctcaaagataattgctcatatttttatatcaaatcgccctcgcaataggtcctatggaaccttgcaatccaacgataggcttctgatgtgcttgatcggtctacttccaaaggaccatacttcaaaatgaatcctagttccatcataatgtcagcggcaaggaagatcaattgctttgccttactggaagaaccggaatcataaatggtaatttcaaaatcagcagatatggcacactgcttattctgtagggagctgcttgttgtcggctgtcccaggcttttgaaataaagatagggaaaagcggacggcttctcattttttgttgtgccactctctttgatgtatttttttattttctcatcactcaccaaccgggtataaaccagagaagaaatatcaagcattactggaacacctccttatgcgtgatgaagacttcttaaatcaccatcataaaacaaatcactcggctctctaattccataaaatgaatatcgcctatgcactcgcttataagggactccatatatctcacaccattccgcaagacatttatctacgccgtttattatgatccttacattgctggttttatttcttgcctgttctttcattgtaataaacatacaattatctgggctataactttcatttaggtttcttctctcaatactcaactgaggattccatccattttcatatgcccattttgcaaaggccttaaaattgtctatccattcatcacaaaccccaattcctctggcaccatatgtataatatctttccgactttttgtcatagcacctttgcttcatatttttccacacattgtataatttctcataatccacagaagtaagccctaatacatttttacccaaacaccacatctccttatataaaaataagacacgacatttcaccgtgtcttaacaaaaaaaggacatcaagggtacaccctgatgtttcttcattttcttagccaaagatttctttagctactacctttattttttctcttatctcaactgacgctgaatacattggcatcgtagctttgacaccatatgaatgatgccattcgttatcctctccaaagtaccaccaaccagattcattaaaagcccacttctgtcctggaaatgtacctacgcccataccaaattctggtgctttgggattttcagtatgattgtagtgtatgccactcccaaattcaacgaggagcaaggtgtttatggttccgtagtcattggacttcgtttgtccggtggctacaagaatagctttgcaaccgtctgtcctaggctccatttccacccgaagagtaattgttttacctaagggggattcgctgatactttgtagggccacagtctggccggcttctgccagacgctgacatagtagttcggctttcctgtgcaagtctgctttatactgttccaactgattgataatatcctggattccttttgatgagaagtttcctcggattactttcttgctcatgatttattccaatagaggagacaatggcccgactttttcatatgttgcttcgaagatatcaggcttgcacgggtataattcaccctttacaccttgaatgatgtaatcgcctacgctaacgtgatggtcgccctccaaagtcttaataaagcactcgtccttatcatcaaaataaattacgccatcatcataagcagatatgccccaatctggaacacctttacagtttgctccgactttcataaaatctttgcaaaattcaaatgcttcaatctcaacaggtttctttctgtatttagccattcgctgcacctccgtctggcaactgtttaatagcaaaaagcacggaattaatactccgtgctactttaacaaccttataatctgctcctttaccgccctctggcttccggtcaacaaatacttgtgacagttcatcaatcggcaacgtaaggtcacaggaacaaatcactttatcataatccgtattcactccgaaaggctccgtttgggcttcggaccgggccggggacacattcgcccggaactttaccgggtctgcatatccaaccgcataatcacctgtcagaagcggttcgtctgtcaccgggtcatagatgatgttaccgtccagatcagtttcatagaccggaatatgattactgtagagctgataccaaagtgcctttttattgcgttttaaccctcgcatgtttcctccaaaagaaaaacagctaattttattagttgccttactttttataaaatatcagtttgtttgattctctcatatgcatcgttcaagtgattcacagcatatgcatctgcatatttttcactaggtattgcatgatattctgtaaaataccttataagcaattgcttatctttataagtaaatcgtgattttccgtctagcttttgcattatatcttgttttaactcaaatacttgacgacgttctttctcctctggtacattatagaaataagggaccttacctttttcgttaaaatcatgccaatgcccaaactcatgtaatatcaaaaatgtagcaaaaagcaccttttcatttttcgttgttactttgacagttttatttatcatctgaatggtcccatcgtaatcataactcaaagagttctcgatgtgatgtaaatcatataactgatcaacatttaacaacggaatatatattatggccgaatcacttatatatttcttcttttcttcctctattaatgcttcatactcatgccttttttcatgacttatcgataaaagatagagcaattcactttttttatttctatccgataaatcataatactttattggagcattttcattattgagtaacttacttatactttttaatgtaggtaacattatattcactcccctttcatctccattatacgacaaaaaggaagttattggaattaatgatttaacaaattctcccagacattataagcatacctgcccaccaccattattctgatatgcaccctgcgtccggccgggaggttagccagacacgcaccgtcttaaaaatcagatcttatttttcaaactcttccgggtgttcttccctgtactttgcacactcttcctcaaaggaagttccagggaacgttttccagcctctagccgcacaataggggcagtcatcagggtgcgacttaccagtagccggaccatactctgccatatgtttcttatgataaatatcttcagctggactttcagctttaataactgcatttttataatcataaatcatgataaaatcctcctgttttcaaatagttaaagtggcatattcgacacttacaaagtttttgccataggcaccacatcaaagtaaaggtcatcttcactctgatatccacgggaaatcccgttttcagaatgagaactctggccttcacttccctgtttagaccaataataaacggcggcatcaaataccacatctcggtaccttgaaaccgccgtttctttttctgcgtcagtatacccatacggataacgcttagagcatactttacggattgctcggttaatgagaatgagcagaaccggattatcctgttcgctcacttcgtcaccaagatatgtacgcacatcagccagaatatctatttccactcatctcaccgccctttattcagcctttgcaggtcttccacgcttcggcttatcgttttcaccaacagtttccatagccttttgaatagccttgtctgctgtttcggcatctatctttccagaaagattaccgccctcatcatatgtgtttatactctcatcagaatttgtctccaatgccccatctgggacattgtctgtcatttccggtatctccattgggacatcttcaccggctttataatatatgccattatgatttaccatatatgggaatctcatatcaccttatcccccttacgcaacttctaacacaaaggttgaatccattccctcgtaagaaggaagaacaatctgcgatacagatgttgaaaccgcaactggagggccgggatccgttttgactgcaatggcgacacctctatcaaggattgtgacatccactttgctgtctccaatcaaggttctttcttccggggtagttccataccatgtattgccaagcatagaatcttccgatggcaaaagtgtgaccttattatccggatagaaattctcctgggtcaccccgtcctctttaatgtacattttatcgtaaagcaatgggatcagtttcgtcttcttcgtgaagaaatcagccaacatttcatcatctaagaaaatattggcagtagcattctgggccagtatcgctgacttaatctgctcactttcaagcaaatagtcaaatgtagcagaagtcatcaaagcatactttggtgtaactccaattgacttcaaagccttttttgcctgcctgaaatcatttagtggttttgatgtggcaggattatcccatgtagcgtcaccggaaagtttcaaataatgatttgccttataggaaccatctggatcgtaattgtactcatatgtagtattatcagcctccagataaatctttggagaaccatcatctgttgccagaagctgcattctcattcgttctgcaacaatatccgcaccatcaaccaagttatttgtatcatcatagatactctgcagaacagattccacataagggtcatcgctttccctaatacgcataatttcaatcatgtcctcttctttaacaatcatggactcacggaaaaacgccatctgcgtcttttcgatcttgaatccctctcggcttctaatggtgggctttgcatcaaagctggaagcctttaacgtaactccaagccctttgtgaatcttgatccacttaaggtcgatccccattttctttttattggggaaaaactgcatcccaagatatgggattttattgctttctccctctgtacgattcaaggcaactgctcttgaattaaaaatttcagataactgcataatagtctcctctcttattcaaatacaaccataggaagagcggcttttgcctctgccgaaatggttacgccggaatgagcctgtgctcttgttgtgttaacatatgctttctttaaaatagttccaataggtctatcctcatacacgtcccacaacaggatccccttaaccgcttctgtgttatcagaaacgccatctacgccgattggggtaccagccttaacaacttttcttccattttccgtagctgtaacagcagtaaaatccagcgttacaggaacaccctcaaattcagcacgattgagaatttccacttttgctccaaatgttactgattcaaattgcattggcatattaattacctcctaaatagtgactaatcactgaattgttatttgttgcagagcctttcttggccagacttacagccatttcctcggcttttgacttctgtccctccccaccgccaccagctccatttggatttggtgtatgttcaaggatctgcttttcaaaatttgcctgcagctcttctttttggctatttaatttcccagtatgtatgttgataaaatttgtagccatattcttggagacttcttcatcttcatgtacgaaaccatcaatgaagccggaccaatcatcttctgtcaatccagcctccttaagaatgctttctacacttaatcggcttatttttttcgcaaattctgcttctttaagctgtgcagcatttaaagctttctggaccgcctcctcagctttctttgccttttcttcggctgaaagattcttctctttttcaagttccaattcttcttcaatagcctttagccgctccaattcttccttattggcttccgcctttttctctgctttctgaacttcaccaccaaacgaattaaggtattttgttacctggtcatctgtcggctgttcaattcccaaatcaattaaatactttttggcctgttctctggtcataataatatcctcctttaatccacgcttttgataacgcaggtcgcacctgctggattctgctatttgacggatagctccaaaataaaaaagaaaagctattcggcttcccctgttttaactgctgaattatttgattggctctttagcaattcatttgctcttgctttttcaacctcgacatctaactgctcttgagttttaaatactgtgtccatataaggctgactcatcaaccatactttttccggatctccaaacaatccacatgttgtaagtgctattaatgggtgtattttatttctcaaaaggtattccaatgactgtgcttttacaagcatattatcagtggaattacgggttattttcacatcaaaatcccgaacagttaacggaacatcattagtggcctgtttgatgagattaagcacgatttggcaatgtttcttttctgcttcaataatgaatggttcatcaagttttgcccgttgctctgcaaaatcccaaccattccgaagatagactgcttgcccagtatcaccgccggtattctgctgacgatccggcattccctcaaccacaagcacttgccggtatacatcatctttggcgacctgtgtctgctcctgatccagttgttccgtcatgagctttacatctgaattattagtctgactggcatccttaaccgttatcgcacctaattgacacatctttataaattcatctgacgtaatctcacagtttttaaaaagcataaatgcctggataaactgctcaatgccattcattcgatcagactgcattttgtttatctgatccaaagctgtaatgacaacctcaatatcagacaatcggtctggattgttaggatattcggttatcggaattccgccgaatccgttaatattagtcactgtaacctgtccattcttaattatgaagtatttatcctctgaaaaacaaagataatactgttgctcattttcgtctttcaactgctgaatcgaaagcatatcccggccatcttcctgtgaatatactacaatcgtatttagcggcgtaggaatgtgaattcggaaaggaactggatcgttcttaccggcctttaaggttgccttataagcagtccctacggaactttgccatgtgccaagttcaatgtctcttgcctgtttatgagcgtctctcatataatcattaagagcgtcaacagccttattgatgttctcatcttttcttcggcttacatattggatcggttctccatatgtctgacccgccttaaaacggacaatctctaaggcatgattttcaaccgttttattattgatttctggacggaccgccttttctctgtataaaattggctgatcacccatgtaataatcatggagataccgaatgaacggcctattgtaattcagaacactgactgctctgccaaccactttcaagatattttcggaagtaatggtggaaacaccggtatacgctaccttgcgtccaaatgcacccttgcaaatatctatataattgagcttattcatccgcttctcaccttctttggcttaaaagtcattccactagcacacttccatttcgggtgttgtgaatttctatctctccaaatagattcttttttattctgttctgatttttcagttttcttttccataattccacccacgaaaaatgcgcccagccgaagccaagcgcatgttgatatacttttcactgataccatattatcatattatgaatgggaaatgtgggaatcttaaaatatgttcgtaaatagcaatttaaacaacaaaacatatttagcggcagacttttcagcacagcaggctatattgaacacagattattgttatgcaattaaatctggtaatattgcgtttgtgcaattaagatttacaacaaatgcaacaattgatgcttcacttagagtgattcagtttccaaatgcgctcaaaccaccaagaaggctttatggattatgtataaatacatggggaaccgaagttgtacagtttgagcttgatccagagggtagaatattcaaagcaggtgcaatgaaaacgtctacagattacatgctatccacgagttatatttgtcaataaacacaatgatcatttaattccatagatcgttactccgttggaacagttagtgataacaccaatattaaccgttgtgtcatttgtggctcttatggaaaattgtcgtactgtactgccgtcataaaaagatgcgtacagtaaagcatctcctttaaacacgctgtaaggagcaaaaactgaacatactgcattgtttgtaccctgcataccgcaggcatagatgtacttgtaagctgacatattcggtacggttgtagctcctgttgctgtaataactgcaatctgagtcacgacacctctgttatttaaattgctattttgcctaaaaatcatatttaaaatacttattaacaaaaccagccatcgggctttcatcatcacattggatatagtctaaatcataatcatagaaatataaatatgctatactctttttttatcagatattccaatcataccaaatgacttgggatattctgctttataactgtcacttccgtttacaactttaagctcgtagttatttattgagaattgatactcgggaatataatatttttctttatcaaaatctgaaaccactttatggtctaaaaacttatacttctctgttaatttttctttttcctttttatatatttcctcatcatacttgacgacaagcattaatgtttctgtctcaaacaatattattgaagcacgattgtattcgtatgttatagcttgagatgtgggtaaatcttcaatggccggcataaaatttttcgcatatgtatcaatctgattcccactattaagatatttgctttcatctgttttatttgcctttttaaagacagtaaagcttaataataaaaaaataataaatataattataaataaatactttcttttcatatttaatcatcactcctaagatatatttattatagcacattcaaactcaacttcaacaaatatccattataagcattttacgaacatatgtttgatttatttttctaaatatgttatactatttttgaaaagagaccaaggagaaattgctatggaaaaacaatttaaaaaagatgaatgtttcgtttttattgaatccggattaaatgctttagaaaaaataggctggtatggcgaaaccaaatttatatgtcctgtatgtggttatgataatgccaatgctaaaagaattaaaacgcctaataaagttcgtaataagtctacttggttatattgtgaagaatgcggaatgctcgctcatggataaaatattagaggtaaagacataaatgtccctacctctttttttgtagagtgaccatttacattatttagttcttaagcgtttctgatgacaaagcgggtcttataactatcatatttccataaatcgctgcttctaaaacttgcccttgtttgaaaattgtgtgcgaaatacacgtatcatttagataaattgatttgccgccgaagtgaattatattgattgctttaagattatcgtccatgtggctatcctttctgccactctacatgcctattatatcatgccccgggaagcatgcaaagtagtttttaatgcagacccggaacatctccctacattttccctgaaatttccactattattcgaacatacattcgactatactgtaataaatatatgtaggggtgataaaatgaacagagttatatttcatatcgatgtgaattcggcatttctaagctgggaggctgtatatagattgtatcatcttggtggcaagttagacttgagagatataccctcggctgttggtggtgacgtaacaaaacgccatggtattatacttgctaaaagcattcctgctaaaaaatataatataaagactggtgagccagtaacagatgctttgcgcaaatgtcctgatcttgttctggtcccgcctaactataatctttaccaacgatcctctgatgcgtttcttaatatgctcaaagaatatagccctactgtagaacagtactctatcgacgaagcttttatggacatgactggtactgagtctttatttggagaacctgaggaagttgccaatcaaattaaggaccgcgttttcggagaacttggatttacggtaaatatcggtgtatccagtaacaagatcctggcaaaaatggcttcggatttctccaaaccgaacaagacacataccttatgggcacatgaaataaaggataaaatgtggccattgcctgtatctgatttattttttgttggccgcgcaactacaaaaaagttatatggtattggaattaaaactataggagaattagcccagaccgatctaacaataatcaaagctcatttcggcaagcatggtgaaattatatgggcatttgcaaatggtattgatttaacatctgtagagccaaccccgcctccaaacaaaggatatggcaatagcacaactatatcatttgatgtgatagaccgggaaacggctcatctggtgttgctgtctctcgcggaaacattaagcgccagactacgagcggataatgttaaaattagcgtaatatccgtaggaataagagattataacctggagtactacgggcaccaaatgaccattgatactccaacaaacatcacacgtgagatttacgaagtagcctgtcagatttttgatgatgcgtggaataagatccctatccgtcatttgggcatacacacaaatcacgtgtcaactgaaagcagccgacaattaaatatatttgataaagtagactatgaaaaactggagctgctggataaagcagtagatgaaattagaaatcgctttggaatggattctataaagcgcgcaagctttgtgaaaagtaaatccatagatcatatgagtggtggaattagcagggagaaaaggactgtggactataataaacagaatgtgttgtaggtgatattatggggacatttggaatcggatcaaataacaatcaaattgatagcggagaaattagaggtaaaatgtatcacatcgcttgtaaggcgtggtttacatccacttgtagtctcagaccgctaagcattaagtttgagggtgatgacggtataatacaaacaatatctaatataacaataaaatgcaccgaagataaaaattataatgggattccttcaaaggagtttctctgtgaggccattatcggcggcatatgtcatgaatttaaactagtgtatttcatggactcttgtaaatgggttatggtaatataatattgcaacaagtgtaatactaccataaattaaataacatgaaaggcgttcaaatgatatgtgtggaagatattatattgagatagacaacgttgaattacaatccattattgctgccgtagaaaataaaaatgcaataaaaaccggagaaatatatccaacaaacactgctcctgttttatctccaaatggaaccatggcggcaatgcgttgggggtttccaaagttcgatggcaaaggtgaaattattaatgcaagaagtgaaaccgccgcagaaaagaatacgttccgtcgcccaatgatggaaggtcgctgcctggtaccggcaagttggtactatgaatgggaaaaacaaggttctaaaaaaataaaatattcactggcagcacctgataattctcccgtgtggatggccggactttcaaagattgattctaaaaccggggaatctcttttcgttattctgacacgtccggcttggtcaggtatttcctttattcatgatagaatgccggtgattcttccgaaagcatgtcatgatgagtggtttaatggtcacgatcctgtaagtacaatgagcaaagctataaatgaggttaagtacaaatcagtatgacacaaaaaggcgaactaccgtaataaaccggaagtccgcctatcgttttactcagctaattctggatatctcaaagctcaatccggatctggagtagtcagctctatcgtctatgtaattcaatgcattctccaaaatattgattcttcgtaatgcgtgggtcgggggttcgagtccccccgggagcttatgtaaaacctcgtgtttgcggggttttttcttattttaagagattaaattagttttaagaaaatttaatttcatccaaatgactaacatttgactaacgtttttatataagctgagatgagcttcttaaaaaatcgcaaaaaagcactatctttatgataatgcttttcatagatcctaaattatgctttcgcctatgtgtttaaacctaatttaattcataatattttcgatatttatttaatatgggagtctcatcaatacaagccaaaagaatttcactttcatctcctttttcaaaatccaataaccccattttcacttcttccgaatactttttccaaacatattttattgccgttgataaaaacagttctccaacaaatcctttattcgttgccttttccaatacttttagcaaaaggaaaataaaaacatatataatcccaaaataaggtaattcacttgttatctgtaatcctttggcttttgaaaggcccaaacttaaaaatccaaaaactatagttaaacatatccagtatgatctggcaacataaattaatattctttttagtcccaatttatttttataccttttaactgccgatcgtataatatttttcctattactctcattaatgagaacttgaatatccttttctgtctctaatttttcaactgatttttggagactcatcgtttcaagcttaatcatttcttcaactgacgtagccagcatttcaactgatatttcttccatatctccagctgtgttttttatcaataattcttccagcttttcttttctagcaatagaaatatcaattacatcaatgttatgcttctgttttaattctttggcagaggttcttaatttttcaaaaaaggcagtattggcctgctgtgcagcataagcattcctagctaaagtcaacaacggaatagttgttgaattctgtgcttttggcaaccataatcgacacataagcatattgtctgaaataatcggtaatgcattaggattccacatagcaacccctttatcatctgctccaaacctgtggatatattctttaatatcccaaaccagagctgtattggttgtgataaaaacaggcaattttttacgtcctccatatttgactgaataatcaccctttcgcaatatattaatataatttattgaatcaatatcattttctattgctctttctttccatcgtaaatgcttgcacttaacaaactgtattaatgcctccgagtctaaattattcttataattcttcttttcttcccaatcgacagaaggttgtactctaaatcccaattttctttctatggttgctcttgcagattggctttgcaatcttaaatcgtaatcagtacatttgtttaactctacatacattcttaactcataatctgcaataacctcacccctttttaaggtttcagctgcattatataaggcagattcaatttctccaactgtatgctcaaaaacacaaatatttccaccatattctttttcaattaaatctgataattctttcgtagactcaatttccagcgtccatgaatatcccattaaccgtaaaattaatttagtatcaaagtaaaaattcgttcctttaaacttttggttacggtcctgattatagtcatttgtttcatacaatccaatataaatcatcattccatttactatatcaataagatattctgttcttgcatcattacattcaagtaaatgggatacatattttccaacataccaatcattggacacaaatttttctttttcaacttctttaactgctttttctgcaaatattgcaacagcatttccacgaaccaataaaaaattcgttaaatattctctagcctgttgatagttccaatttaatttataatcctcagcataagacattagtccattaactaataagcgttctttatcttgcaattgagttttctttacttcaaaaccacttaaatcaaaagaaaaatctttaagtaaatatcctgcaccttttgaaagtctttcaatctttttgtctttttctaagattcgacaacacatttttagcatgtgctgtggcatttttaagccaaattgctccgaaattttatcagataattcgtcatgcctcaacgaagaggccggtgttatgattaagcatatcaaaacataattgcaaaatactgttaatggattatctgtttcttttatataggctaaagcaattaatgcattttcattcttcacatctatgtaccccccattgattgccattataccacactttcctttctatttcatccatattttacaattatcttcacctaacttcatttcaaatatacttacaatttaaaggttggtaaataattggttagctaaccccggatactgcaatgcaccatcagcatcaggagttaacattacaggttcagtaaccattttaccatccgcatctaccgcataaatctttccggaattttctacaagttgtgaagcacacataacgccgtctggtcccaggtagtaccatgcgcccttgtgctgataccagacgtttgagaccatcataccggcaccatcaaaccagtaccatttaccatcaggatcctggtgccaatcattacggacatactcgccggtatcaccgttgtagaatctccatccgccgtcctcctggagccagccgaatttcttttccggtgtagccgtcagagccgtcttaaatgcctcccaagtatgctgtgtgtgattataaacataaggattgggacaaatcttcccggtcacatcatagtgccgtattacatgatctgcagagatgttgtacttcgccatcagttccttggtcagttcaatggctgcctgcaccgtagcctcctcaaaataccaatcccagcttgtatccgcctgactccccttattcctaacacagagctcgatccccaggctgtttgcattccggcattccgggtgagtataggtttttgctccgcaatgccatgctatgttctgatcctcaacagactgccaaactcccccatcaaacccgacataataatgagcgctggctccaatgtattgggacgcgtagtatttacagtttgcttctgcacctcccagggccccaacataatggatcacgatgtacttgatacgatccagagtgccgatattatggttatacggtgtaagtagttttttaatctccatgataatcctccaatcaaaaagaaaaggcccgggagatcccaggcccgaaaagttgtgacgttacaacttgttattcttttagctccggcagtccagctaccgatgtaagtacggaaaggatcccggccagtgctgttgctgatcccaccataatccaatctacaccggacattaccgccgttgtcccgattgttgcaatagctgtctgcgccatcgtctttaccgctcttactcctgctgcctttgcccactttaccatataatctttgttcatgatattatcctcctatttttaaattttgaattatcataacaataatgccggtagcaagcgccccggcaatgatatcaataaatctgtttgcaaacgtccgtttcatgttattccatgtttctcctggagctgcctccaatttagccaacctttccccctggctcccctgctccttaagcattgcctgcatattaagagctaattcctttaccgatagaaccaggtcctgtatagatttgctctgttcttcctgatcttccattcggtgtttcaaagactttatttcatgctcatgggcttccaatctaaccgcaacctccgtttcagtcatggcagcacctccgtttcatttatttagatgcaaggatctcctgtttctgttcttcggtaatccatttcttaatgactgcattcgccaacattgcagttgtcagcgggcccttgccgctatcaaataatctcattaatgtatcaaacatgcttatccctccaaacttgataatactaatgtgtcaacagttgctcttaatgatttgatctctgcagcctgttcctttacggtttcggtcagatccggtgtgcgaaaagtggcggttatgacatctgctgtgatggaggtcacaccatcttctgccgtgccgataacctgatcggactgttttgccagcttgcccgcataaactaagtcagaccgggtccagtccggctctccggataatccgatctgtactatgcttccattttctttcaaggcagcttcgatggactcgaaagaagcggaccctttcaaaaaggcaatggttccaccactttctccaagattaaccccggctgcgatcagatcgaattcctgagtaccaaacttaattctttcgattcttatattactcataatttcctttccgctcagatgagcataaaaataagccccttatgggactgtgatttacaagtttcttttcttcactaaatagcaatttaaacaatatttccgcaaaggtagtaaacagaggtgagtatgctggaaatctgaatgaaattccaaccatcatcaatgttctttctgtatacagggcagcaagtagttgcactaatcttcctgctgcgttccacggcattgtagaaacaatgtttattgactcatcatctttcgcgatccaaaaatttacctcattagaggtggcccctagattttggataagaacgagggtcaatacatggggatcttgggtcgaaaaatgagcatttaggcccttttatatgtcaccgatataattggtgtggcatttattgatgcaccagaaaaattacgtaacctgaccaaactggatgtgatagccacaataccgacagagggattccctccagaccaaagcgaatactgaaatggagtatatccgtttatgggcgtaggggtgtacgaaatatcaacataaccattagccggtaccgctgtttccggaagcgtttgtgattgtgctatgattaggttcggtaaattgctatttagtgcattaagggctgcggttaaattggcacctgcagtcagctctgtactcatgccaatgcgctccgtaagagtatgtacatatgcagcggtattgatcttattctgatcattggcatccatattagtcagcatgttcttaagtaaggcgttttgatctaagttcattgttgttgcaatagccttagatattttccccagcacctgcgcaattgcttccccggctataatattggccagttctgtggcctgcgtaaaggccgtattcacatcaattgcgccgcccgtccctaccgtaataccttggctacccttcaccataccagcagtggattgcgaggcagttttagcactcaatgtaccatcagcgctaacctccgttgttactccgtccggctttaccgttcctacgctgtcagccgtagctttactggttccctgggctgatacctgccagtatgccgtattcgatggcagagttcccaacggcggttctgtatgagctacatagctgctaccgtcataattgactaaattcaacaattcatattttgtatcaggattatattcccccatagggcggatcccgattgttccatatatttcagccattatgctgtcacctccccataaaactttccattattgtaccaaaacctcatacccttggcttccgtatcactcatgagctgcatagtgacaggatccacataaaaatgtggaaccgatatcttagccgccgcgtccacctgttctttcagattctttgtttgttgataataccattttgcattatcttccggatcttccggcaccacgccgcctattgcatatcgtttggcctgtaacgcactatcagaggtttcagtggcgctctgagctgccgctatttggctggcccctgcagctgccgctttctgtgttgccacctgctcactggctgctgctgcgttggctttctccgtagccgtttgtgccgctgcggttgccgtattcgtggcagctgtagcagctgtggctttttgcgttgcaatcgtggcctgctccgtagccgtgccggcactctctgcagcggattgagcattctggattacattttcctctgcggttttcgtctgctcgtaataatatttagcattatctatttcactccctggaaaactctgatctccaagcgtgtaccgcttagcaaataattgatactgaagggcggcatcacgggcggcctgagcgtcaagcatatactgccggaattctgtctgaatagcagcatctaattttgccatggttacggaaccatcaacaatagtcgcccgcatgactcggtcagtgatcgtcatggagatagtggccgtacttgctaccgaataaacaaatctggtaagatcaatgatcttctgcgtaccgtctgccagggtaagcactaactcattatcatcgttgatatcaaagtttgttactaccttttcaatatccagatcataagtcttaaccgtaccattttgataggttattgttaatattccggtgtcagcgtccaccgtaatgtcttttaccaaagcattaaccagggatttatctgccttgcttgcgtccagctgtacggtcctgttatccagttcctttactccattttccgtgtgaagtaaattagtccgatttagtgctgttttctgcgatggcaagttctgccaatctgtaacggtgtaaaatggttgcaatgccattaaccttcaccctctttcttttcctcctcattgaccctagcatcaatgtcggataacttttcccatttactatggacaggccttttagagggagtatcactaacactggtcttttgttcaggcggattctcccaatcatccgaggaataatgattttctttcttttcaggttccttaatttcacccggcgttcccagctccaacatttgcgcaatggccgctatctgcttggcattctggatcccggtcactgtgacagcattcagcatgtattgaatttgcagcacctgctcctctgtaaaagtaattactttattcatagactctcctttcttaaagtgaattgccatattctcccaaatcttctatactgtgattacaggtcatgcccggccaagtacagaagaaaggagaaaaataacatggctttggatcctagaatcaaaaaagttgctgtagactacaccaaagaattgatggtagccaaattgtcaaactcagttatcacgatggaagaaaagaccggaaagaacgtggccttatttatgcgtgaaatttacaatgagtttgtagaattacttgaagatacatacgaatcagaatgatctcgtaatcttccataattcaatcaaggccaatgctgcttctgggataatctctacttctttctcagaagcagcattacttgaaactctttcaatgaaatctaatagcgccttttctaatcttttctgttcttctgacatctccttcacctccactttttccacgtaggatactgttaactcatcacacgctcccggaattccagttgctttttcagcattaaaaagtctcaccaacggccagccttccggacccgggagcgtaacaacaataggtttttctttataatctcttccgttgatctttaaaacgccaacatcgatgtcgatttccaaactatgtatttccattgcttcttactcctttcggcacacaaaaagagcggggaataatcctcgctctctgtaatagtttttattaaattattcgtggcttgtacattcaggaaggtactgcgttgcaagccagtccttaaactctgcactgtcagccgtcacaaggccatctgcaccagtcttaaggccatcatagtactcataatcggccttcagttctccatagcctgtaaaggcatatagaacgccgtcaatcttagttactcccaccggaattgttttatcgtcaaactcgaatgaccagattccttctgaagactgggaccattttccggaataagtgtcacggttctgtataccttgccaaccacgcaccattccaaggtcaaacattcttttgatgttacttattttaatgtcttctgacattttaaattgtgcgcaagtatcatcgcttaaccatgtccaccctttaccaagttcttcgtttagtggtgatgggcgttcaggttctctatattctttccccatggcaaaagcattaaaagaaaataaggtgataaataatacagctaatatagatactatttttattcttttcattgacattacctccttatctgtattatatccactattttcttttaaatcaaccctccttcctatttcttatgaaatatgaatatttaaggccatcatggtaatctgttataaatatctttcagcatatccacgagactccaaccagcaacccagggatcgtctaaatatatatcattgcaattaatttgttgagtattcattccaccccatccaattcttgttgtaacggtccctccccttttaaattcaagggctggaccgttaccaagcggccatgcactcgtatagagccatatttcatcattctgactaaaaaaggccccatattgatttccggatactctaaacgctcccaaatctgtataattagaattaatacttataggtcccagatcaatatttcccgcattaatagcagcattccctcctgaatccacccagaaagtaccgttgcctatattgatggagccgccacttatggaagaaccaatcacctgagctccttgtactcttccactaaatgtggcatttccatttccatcaagttgaaagtttgtactgtttacaatgagcctattgctggatatcgttaccttatcactctctactgaaagctgtgaagaaacatcacccttgcttaccttcagggcaatctgatttgccgtctgcgtaaatcgggaattggtatcattggcaagattcgttaccgatgtagcaatctgatcagcgcgaatactcaatgatgcttcggcttgttttgccctggtaacttccgcaaggatctggtcagctgtcaccttaaattgcgcttcggtatattccttcagatctgttaccctaacagatacttcttcaactgatttcttgatgacagctgtcttaccttccaattgaataatctgatcacttaggccggttctctgctcctgttcaatattgccgctagcctcgtaagtatccatcataccctgaatacctttcgttgtccgcttaagacaataggtttcaatcacatcatcagtagtatagcagataatgccgtccccaacttccacccaaggaagggccgggccaacgatttgacacggcctataaatccttccggaaacctgatcataaaccgtggaagcaatcgcaagaagctgttcagctgacttcccatatgccaggaaattcccctggattacatagcagttacttcccggtccataggaagccccaacgtcaccttcctcctgtctgatctgcaccttgtcaataggattgaccaaatagtcttcataatgtgtttccgattgcttgtagtaggataaagtttccgcattagtcatctcagcgggaaataattcatcatcaggaaataaggtttcagatggaaacaaaccggaagttccaaggaatttatatgtaagcctgccagtcttatcaatatttccaaagcacccatttatttcgcatatagccattaaaaccttacggccattcaattgctctggatcaatagttttagtcaactgcatatcgtccataggtaaagtagccgtgatttgtgtaactcccacatgagcgcataacgaatcccggaactgcttcaaagtcataggaaaggtaagtccccgataccaatccgctacatcaatatcaaatttcagcattctgtcataagcaacaatctttttcattcgtctatcagcctgacgctcaaaactatctaccctataaatacccaacgccatttcataaccaccgatttcaacagtggccataaattcttttccagtcaggtccatcaaaacatcagccaccgttatctcaaactgtgatgaattacattctccaaatgccaagtcttgacttgcgcatagattttcctctattgccagtgattcagaataaatctgactgttatctatcacatagaccggttcctgatcaactggaaataagtcatctgatgggaagagtgtatcttctggaaaaagtagccttatctcctcatcataaaaacgaagtttcaaatgctttacagtttctgaccgggcattatctgcccgaaacagttcttttatttcttctgggatattcagcatagatctagcctccttaatactcggttattgttatcttaataggcttgtatagtatatcctttcttttctcatcaatatttacaatttcatacggaatatcggaaatataaaacgcccccgacttatacgaggacgtattgggattccaatattctatttcacattttaccctgttaccatgggggacaaaggcgtttagtctgtcaacatctctcaatcgcagatgcgtggtggagaattccatggacgtagctgtatgtggcaatacgttacgatgtaactccccacttccatctctgtaggggtccaggtccattatctgatctggtatacatttataggattccagcgcaatcaattcagttggaaacactgttccatttatttttaatagccagccttcaaatgccaaatccccacctccagacataacaaaaagcgccatctctaggataacgctttcttttcattctataccacaatatcattttaacatatatgaaatgggaaatgtgggaaattttcttttagtcataagtataccgcacaatcgaatttttcccatcattaaataaatcatctctttgtaacaaaattctatatgcattgtcataaaatggagaggggaaaagattattgaattttacaagttctccatcccccaaccaagaatagactatatcatttcgaaccttcaatatgcctacgacatttctagagatatcataatcacaagaattatcatgtaatcttttttttagtataattgcatgttgtgcatgtggtcttaaaaaagttgaaggtaatgcaattcttaagtcaattgttattatatcatttccgttttcaacaccattaattgcttcattactatctgccgcaattaacataacatattgataccttaacggatcatcgccttttaatattctcgttatcatttcagaactataattatttttaattctattaatatatgttgcgtaggtaattttccctatactttgacagtaatatttatttaaaccaaaccataatgcaatccaatgattatctaccgcatcaatgcagcgagtattaatcccataatgctgcaacataccttcaataatatcatatgaatttttgttatccttgtttaaatgtatttcttttgaaaattttttatcatttaaagaagcattgataattttttttagtttagaaattttcattccacttttatttgttttttcgtgaaataaactgggcaacaacgattcatataaattacattgtcctctgtaataaacttttccatattcctgatttaaaagtttggcataaccaataattttatttaatccatgacagtcaaaaacttcgtaaattggtgcgctatgaccactactaaatttaaaatcatcaacgtatattgttcctcttatattgttttttcctaatacctttggttttttcatattaattctccattaatgttttttctaaatagtaaacagattagttcattcaagttatataaaaatattatatcaattcatacctaattgcaacgatattcaataaaattctatttctattgtaactaattcaaaaacttttcaatcttcttttgaatggttgtcctatcataattcaatttctttgcaatctcgtcataaggccagtgttcaacatatctataatacaggatctgcttaatttccacctgctccggacccaacttttcaagaaaacattctatctccaatttcatatcttcaaaaagctgctcgttacctttcaaatctattaggagctgccgaaccgccttttccctttcttcattcgatttcacgtttgcccctgaaactacaaaatgacattccgtaaatgggaactgctttaaagatcctttcacaatcccatattcagaagtcaatggattattttcatagtattttatcctgcgcctaagacgcttaatttcggattccagatatgtataagtcgctaaatattctctcgttaatttcataatcaaatcctccccatataagtctgctgattggctcccaggcctgcacttggcgtattcaatgcaacttctaagtcccaacccaatttgtaaactctatctctaaccgttgctggttttaaaccatgctccctacacacttgagcaaaagattttccgttagcagggctttcaaatgccttttcaggggaccacccacaagtaatacggttatgaaatgtatcatacgtcagccctaattcattacaccacaccattaaatcttttgtccgtcctcgataagtgacaaatattgaatcccttttattaaaagcctgctgttgctttgtgatccatatacagttatccggctcgtaattgccattcacatcttttcgctctatggtcaatccgttcctgtatccatttgcttttgcccaatctgcaaatgcatcaaagcctttaagccattcttcacatatcttgattcctcttccaccgtagtctttatagcgcttgcaattaggatttaaacagcgttttttcatgctatgataagaattccatagacttaagttttctttctttggattcctcaatgtttttgccatatagtaaaacctccttaacacggtctctggaaaactgtgactttagcgccacccatattttgtgtgaacaatgcaaactgcgcccagccatcgggtacatcatcatgaacgttcttacctttcactgaataactaagcagaaaactcatcataaccccataatcacttttggctttgtaaagagaagaatctttgaataaaacatgtttctttacccagtccgcatttacgataatctttgtttccttattgctatcagtgaatttagtggtgatgttacaacggccattcttttgctccaccagtttattcacttcgtaccctacccggctaccgccattattgctttcgaactggcactgctgcagcttattatccactattatttgggagcacctttcgtattgaattccatagtcagaattatcatcacaaacacaatccaggcagtaataatcacttccgtactgagccacgcaaggaagaaacataaagtctgttcctttgtccttcgtatcacatattccaagtaaggcatcaggttctccctgcggaagtgtaaagtatcgtcttaattcatcttcatgatatagcagaccctcacgttcaataggctggcttttataaagacacttataagaaatttcgtccatagccagtgcctgatcattaaagaaagctactgaaaagccattgtattcatagtcaaagtttgattcctcagtcactggatcaatatctggaacctcaataaatctcactctgtcgcttttttgatataggttttttattcgtccaatcacatcatggacagaccacctcgtcgctatgtgaatctctttacagccgtccatttttctctgtttaccgtccacactgtatagggaccaaagtttatctaaccgaaccttattcagagcttcttcaatgccgccaataagatcatcacaatacaggtaccggttacacctaactttaccggcattctttgagccaatggacgtacactgtatgttggggaaaggtttgtatttattaaaatttattgtctcagtcttggcattcgtactttcaagtctcacgtctgggaatatttcgctccaggtgtattcatctgaatttgtagtgatgtcataaataccgtcatagaacattctggtaatatcgccactatgggaatagaacaaactgaaatcatctgggtgcttgccaattacccatgaggcaaagaacttctccaaggtcgttttctgcgtcccaggtggcattgatatgcttaagatatccagcctatcatcttccagatcctgcatggcctgaatcaatccatgcttattcagctgcttgcgtttcggtaaataaaagcgatccttcgcttcccgattcttctccagataaatcagatacgattcgaataaatacggagcctcaaaatgcaatgttttccagtacagatcatcccaacaggtatccattgtctggacaaatctagtgacggcccatttcttgataaacccggaataggtcatgatgaaatcccgttcctcaacgggcaaatccggattatcctgcattgtatattggagttctgataacagaatgtttagaatgtcgtaagaaggcggtgattcaatctgccgctttaattttttgattatttcccggtgttcctggaaatccatagaaaaaagcctccttcctctgttattaacaaaggtccgaaggctcacaaggcactggtttaaatcagactttaaaaatcactttatacatttacaataaaatcactttggcacttgctgttcttgcatttatacggcatcatatgtatttttgtttctggcaaaatctttactgccttttttccacaataaggacaaactgcccaacggcttccatctggtaagattcttatatccgcttgcccgtcaaatccatcttccggaggattcatggatttttaaaaccacttataaaacctgccattatgctttcccccatttctaatccctctttagctgtatagcctctatccattttttgttttcacctcatatcctccgattaaatcatccagtccaaatatgccatcatcacaaagatgatacaaataaactggaccaacaggcacatcaacaccattagtttgcatgcttcctcttataacacctgtctcttgaaattctttaccgcaccggcggcaacgatatattacaactggattactcttttccataatttccccaacctcctacaggttttaatgaatcatatctaatagctgctggcaaaacgcaatatgccgtttattcaattcttttgcggcttcaggtccaacccctacaccattaaaggctctaatttcctctttactttcaatacgattccttgaaacttcaatctctacccgtaaaaaatgctcaatctcatctgcatgtaggttggttgtatcacttgtaatcgttgcttctcctgtgataaacagcattgagcaactttcagtcttaacaccctttaccgtcatatcaagcagatcaattaaatgctctcttcttaatttttcacagctctttaggctcttataatcaaggctgatagcaaccgtttcattatcatcaataactgccaaaacatctcttaatctcatttcgtcctccttttcataggcatgccatgaagccgccgccaattattctgctggacctgctccaaggtacataaaccacatatgacagcggccaattctcccggtggtaataacacagccattgagaaatccaaggaaacaggcttcttaaattcgtctatggccttttgcagttcttcatcttggtccattttaaaatcaagcactggaatatcacttacagggatctccgtgccatcagtaccacgcatatataccgtttccgggctttcattccatttcggcggcatagtcataccctaccttccaaattttccacaatattgatacaccggccctcattctggcaccggataatattcatgactttggaagaagaatccccgatcaaggtacaatcctctttatcgacctccggctcaaaatccgggcagtaagagcaaaagttacgtaagcaaagctggaatccgtccataatccacctcacagcaataaacctatcaggaatattccataccataacgtacttatcttttccttatctccagttacaaacttccaagctgcgtataaaaatactacgaatttaatcaccataaatactatttcaacgttactcatgttcccacctcattttcccataaaaaaactaccaaccgaatattgatagttggtagcgaaatcttatttttcttttttaattgcgactaattgagtcattatcctctctccatatggggttaatttccagtatgttaagttatctttaacacttctattcttgatacttttctgtatcaatccaagtgcttgaaattgtactttgattatttgaaaatgaccaacttttaattgaattttatcaaatgaccgtattttcatttctgactttaaaattattatttcatcatgacatttttctttcatgtaggttgtaataacctctgtcatatctacctcgtcacattcattaaccaaataaggagctacaactttaaataattcattccatgtaaacacaaaatccattgagcttgaatatctattgttttgtttatcaaaatacctatacacgaaattcaatacaattgtatcttcaccttgtgagaaattttccgctccatcaggtgcttgaatattacttaactccagttgttcttttaattctttgttttctttttgaagtctaagtaattctttcatcgtattttcatctgttatattatcagctttgacccaccctgtagcaggaaatgttttaataagagtaatcatactccttgaaactacgcttcctagatcgtaagggttagtccaatatttagtcatctttttttgggccaaatccctaaatagatttaatctttccttaccttcttgcgtatcctcagttttagctgatgatatatctcctggatttttatgcagaaaagctattataggcttattcgccgccaaagcatatcgatattccatttcagtataacccataccatcttcattaacagaaccatatctacctgctaaaatcaaaatataatagtcacagtcatcaataactttttttattaaagtccattggtcatcattcgaagctggaaaaagttccattccagccggtatgcagtctaattcaagtaatgcttgcataacttctttacgctcatcttgtaaatctttatatgttgaactaacaaaaacctgatatcgtttatccataataacccccctcatcatttgtaatagaaaaattataccacaccaaccatcaatattcaatttccaatgtgcaaatcaggctacccggattcgaaccgggaaatgcaggaatcaaaatcctgtgccttaccgtttggcaatagcccatcgtggggtagaaccatatccacgcaaaccacttgcatgaagcacgttcacttactggctactaagaacagaaataaggattttccaaatgccattcacccatattcatgagttcccatgtgttttctcacatgaggaatttggcttattacgttcacactaaactttcagccaccaatggaccctttgggattcgaacccaggacattccggttagaagccggaggctctgacctctgagctaagggtcctaagcacggcccgcttagattatcataccgtctactcaccctcttatggagatttcgcaagcgtacttgtgcacgaatacgctccgggcgctttcagcaggcattgtcattctctgtaaggcgttgcgctcactctcacatcagccgatagctattcggcaacgcttgcttccttagttatgatgcaactcttagacacaaccacaatcctattagaccctgcacctgctccattaggttgtcgctttcggctgtgaatgaaaaaaagaagcaaatgggaagtataggttccgaccctatctctcctgctcttcaggcaggcgctttcaccagattagcttattcccctcttaaacaattttataaattgcggtggcaggaatcgaacctgcgattatccctacgccttacctgccatactttcaatgttagcctcacacatactcatataacgggattgtggatttgaaccaccaccgcaatcacgcaaaagtttgcaacctcttacttgaaattctctgactggctaagccagatcattcccaacaggtatatgcggattcgaaccgcatgtcttgcttcctgacgtatgtctgtcaacctgcatgtcttcacatacgcttctgcctgttttaaccatcataaaactaatacctgctatccatacatctcccatcgacaggactttatgcagaaaatcccactaagtggagacaaggataaaaacctcacggcagattcgctccgccttaacagcaaacagctatgaggagaaaatttttactctaaccatccgttatccaggtaatagaatccgaacatcacgacaccagttaaagcaatccagaatatccaaaacagccataatccaattccagaagtcttttgattcaacgcttcttcaatattcatatttttaaagaattccgtattgtctgctatggtgccatctttcagaaatgtatatatggatccggtgtgttctttcgggcaaccataatatttatatctgatcttgtttgattctttaattgtttccatgtactcactatgtggaataactacttttccatagggaaattcaatttccaaaaaccgtatattgttcgaatgtatattttctgatccgaccttatcccatgtccaatatgtttcagttgttgtccatgaagtttttccattcgaatgatgaactgttctggtatgtcttgtatatctttctttcactttttctacatataagtactctccgccaatttcagggtatgtcaccggatcaactgcttgcaggttcccataaacaaaagcattcccaaggcttgtgtccatgccataacggaacatttctgtgtccgtaatatgtaccgccttattatattcagcgttcttatccatctggtaagcttctattttcccagctatcacaaatccaatcaggaacataacagcaacaatggtaacgctggctatgacttctcgtaatgtgatttcaaaatctccaaaatcccatgaccttttcatatcaagtcctctttaatcttcgtcaatttcaaggtaagcagattcttccaattcctctgctaattctccaagggctatgctgactttcataaccatttcctttgcttccctgattaccgggttcttaagcgcttcaacggttaaccgtccgcttgcaccatcaagtgttgaaatcatctcatctatggacatctttaattcttccatgaatcgtcctcctattctttaaacaaattctgaggagcatctgacggggcattgtaatccaatcgctggtaatcctgacgttcatatccgcaccaatcaagataaactctggctgggaatcctttaacataacgattatatgcacccacctgccggttataattctcccggtactgtgccatcagattttcggttgtggctaattcagtcatgagctgcttataattctcattactctttaattccggataagcttcagataccgccgttattgccgttgtcacattctcaatatctccagtactgccccgcccctctacaatcgctgtcagggtatctgcctcgtgcttatcatactgctttacgcaatccgcaaggttataaaccaaatctacccggcgcttttcttgcaccttaatatctgactgagccgtctgaatggattcttccaggtagattgccttattctggcttccctggattccaaacactcccattaaaatcactgcaaatactgcagcagctccaattacaaacactttccaattcttcatttccaatatcctccctaacaattattgcggcagtggtatgttccccctaccatcaagttaatttctttttcagtgtatccacacttgtccagcccgcggacccccttatatttttcctttggtggcatactttggtattctttacaaattatctgtacacttttgaggattctatctgcaaactgtagcaatacatcgtttacaatcacaatcacgtcttttagggattcaaagacctttacaattgacctcttgaactcaattaccagtattcctgtatgtactatttcctgtttctgttgctctgagaaacaaatcatatcagttacctccatattagcggcaaagccagaatatacatgattgccataacaccaaatccgactgttgctgccttatctctcttccagatcagtcccctggaaaaccaaagaataaaaatcaccataaatacattccaaaccgtaacaatccacttcaatgcttccaattctctcacccctatttcacatctgccaaatcaaacacaataccccggcaatacggctgcccgtcctcatacatcatgaatgtttcgtgtggaatatccgttttatatgtccaggtaatgacattcccatattcatctattgcggacttatcgcaccagaaagcttcaatgcagtttgcacgctctgaatcatcttgtgatacgccattccggtcaaagaatacctttccaccgtcaaagcagccaccctcatcataaatggccccatcaaaaatcattagatcatctgaagctccgctaacaataaccaaaccagcttctttcgctgcctgcctaacactactaaacggttcaggttcggatctgtattcatacccatcaatgagctttgccaattctttcttgtccatggagtcccctttctcagcacttataattttttgcttttccaaaacttcttcaaagcaccgctgactgaagttttttacattcgcaaaatcaactgctgacatctgacgaagctggctcactgtttccacacctgcacgtttcagacagttatatgtcctgacagtaaggtccagattgtcaatgctgtcccggtccgattctgcaccaacaatacggtctgcaagtccctccgctacgctgtataaaccttcattggctggaatggctctcaaatactgtgcaatggaatctaccagagcattgtaccagtcacctttctgcataaattcagttcgcatgatttctgctgcaatctggagtaatttattatcaatcttaacctctgcattgttcagcaatatagctgctgatggcaccaacggagcataaagagttaaatttgggtagcacccagcttctatcctcaaatcaaccccagataagagattgcttatatctgttccattcaataacactgaattatttactttatcgtttttgatttctacttttgacatttcataacctccccaattcaataattcattttattttgccactcatctttgcatttaaaattgctttcaaatatgcttctggattatctttagcaactgaaaatccctttttcaaccgctctatttcctcaatagagtttttgtacttcggaagatttcgaaccctgtctctaaacatatcaatctcttccttcgaaataatccctttatccaccaaaaggccaagtagcgcctgaatatcaatagcagtacaaagaatacgctcttgaagcattaattcctgtaacgcttcctctggcttataatacgaatcattacttacactcattatatttacctcatattccagttacgggctactttacgcccaggtgccgccacctgattgaccgcatttaatctggcttcccatgcacgccggaacccgtagatttactttttaggcttatcttttctttttgcttcctcttcacgtctcctttttgcctgattcaaagtaaattgcgttgcggcacgcattgctgtctgtgacgctattattgctgctatattaatcatgacttcctacaaccccttttttattttttaagaaaaattgaaatccatcttctggaccggacccgattaacaagtgtcacgttatcgccatctttctcgatttcaacatcacagttataccggagaatcgtccgccggaactttctggccagttcttcatctggcagattataaatcatatacagattcccggccttatcaattataggtttctcgccctcatgaatatcactttcctgacaaggaataacagctcctcttgtatgtctgccaaagtagaaaaataaccagccggctaatgggcattttccattgaggtagtacggatcatatttgggaacccaccaaggatcttttaaagagaactggatataccattcatagcattcctgagttttgaaatttacaaaagcaaacaggaaagttcctctatgccttttggcaaacaataattttcgattgaacatttatgtatcctcccgggaaaaggcctttttatattttttaaaaatttgagaatcacttttctaagaaacgatttcaacaggacagcctacaagcagttcaatatcagcttttgaaagcttaataggtttcccaatgctcatatcaatttctttacgatctcctgaaattcctttggctatcgccttgcccttaaatgccatggtttcttcatcaacataaatcctgaaaatgctatatccatgagcccggcagaagcgcaatgaatcagatagtatcctgctcatttcctcatcttcttcaccaaataattcctggtatgtataagcattatctggtgaatgaaaataagccggagtagatatccacttaggaaattcagagaaatagaataatctattgttgaccattgctttcaatccaatatctgttctatatcctcgtgcagaagccattctaagcaatctttcactttcttcatttgtcgtagtggttataaattttcctgtaaggtctaccatgatgaatacctctttactttcttgatcagattcttgactttgataaaaagccttttttgattttttcgttacttcgggacccaactacgcctaaaaatcaattcctatagacccccctgccgggtgtcttatttgcttgcgttttcaaagttcgtaaaataatcaaattacgaactattacgtatttacaatggtttcatcatatggtattatggtatcaatagattatacgaacttttaataggtgttttacgaacttttaaggaggagtacagaatgaataaaaaaacagttgcactaaccagagaaacatatcagcttatcattgacactatccggtccggctttacggccaaggacggaaccatctgtaagccaaacaaccggatcgctactgccttagtgctggaagccaacctgggcttacgtataggcgatgtgctgcggctccatgcctgtgacataatcaaagacggcgaacgctatcgccttgacatcacagaggggaaaactaaaaagcaaaggaattttactgtaccggtcgaactgtataattacatcttgcaatatgcgcttgataacggcatttcaagccgtgcaaagctgtttgacataagcgaaagagccatacaaaagcatttaaaactggcttgtgaatctctaggccttgaaaatatcggttctcacagcttccgcaagtattatgctaccgacatttataacagcaatggctacaacattgaaatcgttcggcaactcctgcaacattcaagtaccgccgttactcaaagatatatcggtatacaaccgaaacaagtcgaagaagcaatacagaaacatttattcttgatttaacatctgccctggcattcgccggggcttttcttttgcctttaatccggtagttcgtcagccgatcccggcagcaggtccactgtttttgctctgtcctcaatctccgaccgggtgtattccggtttcccggccttatcatcgtaggctatgatctggacattatcccggtatccataattggcttttagggcgaacatacagccgatattgccggtttggattacctcatcgtacaaagttgactcgcattccgatttccatttttgtgccgaaacggaatggccggaagcgacccgcccatcaaattcaccttttaaccagctgtttatcgtgtccttgttaatacccgccatcatactaaagcggagcagtgtgggcttaatcctacatgtacaacagataactgtatagatgtcccataatatatttagttctttgatatcatactctttagtgactgtattaaatccaactttatatttacgtcctatatcctttaataactcagataatccttgagaagaacatagattaatattactatgcctctttataaactcattagatatatccataattgtagctgtaatattattaatataatctctatcgtctgtatctttatcatctgtatcaagctctatatcaaagccatctactgtatactcatctgacttaggcataatatttataactcctttctggctcttatacgggtatcatatatacatcatacagatacatataaaagctttatatatttaacatctgggtacttatcattgatatcccagtaggtttatttaattttttacaacctggtctaccagggcaaatgttatccggtcatcaggatcggggaggatttgaaagagtaggcctaagcattcgttccgttgctcctgatctgtgcatttaccggtctcacaaaaccggcaacttttccgatcacatttatcactcattcctttcatctgcctcacccctcaattttagattcattctgaatttgttctagttgtactataacctatagatcaaatgctgttttagcgttcatattgccatcttacgccgtttccaatctcttccgcggacattttctcgtctacctccttaaaatcgatttacggccaaataaaaaagccgccacctgttgcaagtacgttatgcaacgggtcacggctcctagagctaccagggtgaaggagtaatatataaaatctatatatccctatcctccgaaaatgtatatattaacgtggctatatacggccttctttcaattatctttacgataacagaatatccaatatctgtcaataacttttatttattaatcattatagagtttttggagaagtccggccttgcatatgatgcaatgatcatgtttttgcgcaatgtatttatatatctatatctaaatctgtggaaacattttgtgtacaaattggaatcaaaatgtatacgaaaagagccaacaaccgccggtccttaacatttctttctctgcaatctttcccactgatcaggatatgcttttgcgtaccactccaagaaaggaccgtaaatctctttctctgcttgctttcgtgcgtccattgcatcagttaaaacatcgtaacctccgagataataattcttgcgcttaaacattatttgggctatccacttttttcgcactttgttgtaatacacgcccgtagctccggatttatttgacgcactaatcgtggatgtcaatttacacggggctgtaccgttgacataaagctccctaatcttgtccacacaaacatggccacatgatgtcgtactcccacttgctagactgccatatggcacatcgaccgcctttccacaactgcactcacaatgccaagtcatactcatacccttgccacgctttccgtccaggaggggatacttcgcggtaagctctccaaaggtcctgcccgtgatgtcgatatacttcggatttctgtttttatcgatttgctctttcgccgcttcgcttcgcaagcacccacagcttttagtagttcctgccaaaagattcacggcagcaacttcacagcttttcccacagtcacaggcacaatgccaaatcacggatgtaccgagtctcttgtctgtgggatacttagctacaagcctgccgaatcgctggccggttaagtctctcacttgcctcatatcctccgcctttctggattcagacataaattattataactgatattcctttcggtcattatccgtgatctcttcggcttcatccatgaaccacttataccaagaatctttgtactcttcctccgttgcatactcatcaagatctgagaaatcgctatcgttctcgatctgccgaagatatgtttgataggctacggagtttccaaaggcctgccataacggttccccgaatttttcttcatacgctttttcaatcccttcgattgctaactcccatgccctttctcttgtcatcataatcttcctcttttctcccttgtcttgcaaggtattttatttgttgcccctatattatcacttccaaaagttattttcaagacattttttaaaagttatgtttcttttttatttcctcttcttcttcagttgctttaaactctatcaaatcctttggttgcatatccaatattagacatatccggttaaggctttctaaggatatagtagtatcctctttcttaattttctttagtgtgtcttgacttaaaagctttgtcgtctttgccttatacaaattaaaccctttgcgctccaaggcatcagcaacatctattttatatcgtaacataacgcacctcctccagttaattaagtataaaatatctttgacaaaaagtcaaatcatatttatcacttaagaaagttataaaatcgcttgacagtcactttctaaagtgatatagtataaacatagcaagcaacacaaataagtcaatcgaaaggcggtaactatcatggaattattcgagtttattatgacatatccaaacaccaaggaagtttacaaagactatagatattttaaaagcaccaaagagtgtaaaaaataccttgaaagttacggaatggaagtagtaagaatacagattgccaattctgtttatgatgatgatattttgaaatcagcaaaagaagaattagaaaatagagaataaatcccctgaagagtctttgaaaattaagacgaaaccgccggctggcggtcgggatacttataaacaagtcgcattgaaaggcggtagaaattatgaaaatgaacattgacatcgaaaggctgattgatttagtcgaggaacaaaacacctgttataacgattattgctattctgggaagacactttacaacggagattttgatggcttgaaaaaacgcaaagatcacctgtcatatgccaatcagtcacacgatagagcacaaagcgcagttcaggcgattatagaagttttacaacttgatagtgaacagcagaaacggctttacattgctactcgtgcagtttgtagctggagagttcgcactggttacgctttcttaatgcctgctaccatgaaaaataagattcacaatttcatattcgcttaaggaaaggagctccacatgaaaacagaacacagggtagataactggaatcaaaataaaatttggatctgcaaaatttcaaaatgcaaccactactacataggccagcaagtaggttgcctgaacttccggccgataagagtttcaaaatctcattacatgtccatcatcttcaattcgaaattcgcttattaggcggccactgccgcccctctaatgcagccggacaagctccgcaggtcacaagccctggtaaatgcagagcggaggaaaacaaaaaatcggaggtaacagaatgattaatttgacaacaactgaaattgcatggattattggggagcttgataggaatgcggcaatcaatacaaatgccgccgcgtcccccgaagcaagcaccattgaaaaggggctcttaaatctcaaagcggagaacttaaccagtatgtctaacaagctccagaaagcccttgacagtggagacaagcgaattgcaattatctaatttaaccggcggcggtcaagccgtagcgtcaaagcaaccgccggattaccaaattttaggaggacaacactatgacaattaaagtaaattatgcaaacggtgacaacacaacaacacgcttcaatgggacagttcaagaagctacagcttattacgtagggaaagtttttaatatcggaattgtttctgataacctccagaaatgcaattctgttgaaattgttgaagaggaaagcgatcggaatatgcttaaagaaagagaagaggaaataaagaacagttacatggtaaaatcccaagacgggcaatacgtgataatgcaaaaggatttttacttctctgagttattaaatgaatatcaagactactggactttatacaaaccataaaaaaccttaaaaagcgcaatatcagcactgaaaaagatagtggatcagcacttcccagcaaattattttactgcaaataacagcatagatgattttattaaaaccatggtccagtaaatccaatttaggcggttacggttaagccgtgggcggttcagtccgccaccgttcttttatttcccggctcccagggataagggaagaaaaaggaaagatgaccataccaaaatatgttgacaccttacttggatatcagggccgttataggagggtcgcgttaattcatcagataacaaattacgccaagtaccccggttgcatagccgggtacttatactgcattaaccttgagcgctataaatacccccgttgttttcgaagcaatatcgaacgtttcgctaagtggtgtcgccgtatgggtgctgaagctatcgtccacaccgtagtagaaaatggttggaacacctatgccatagtcagtataactgaccctgtggctctagcactcgaaaaagctggatacatcgaaaaatagcactcgcaggccgttggagtaccgctggttcgattccggcggcggccattaagcacttgctaaaggcgtgtacctgcctactgcctgacgcaagccggcaactatccatcttacaccgccccggtgatgtaatccggcgtttaaacggttgcacgatagcaccccgcatatgatcaggctacgccctacaaagccacggggcaggacgtggacgggcgcggcttgatgtatgcaaaaatctaagtgaggaggtacaagcttatgtttgataaagctacgcaacgcgggccaccattctggcggttcaattggctttctgattttgtccttgaagtctctactggcatatgatatcataacaccaaatagcctttatattggttcgggtctctaaatgcgatcaagtgaccacgtgctatcttaatgccctctgcggggcaaatacaaggccctggctggggattaagccatgtggtaatgcctgcataatcatagcaagaacgataatcctttacaagagcaatctgaaaattttcaaaatatcacaaggatatgaactggatttttttcaaaatatcagcacaatctaagtcagatttttaacgttaattttcaaagtttcaaaatgagcattccagattaagaaacgcatacccggggggtatcaaaatcatttaccttatttgaaattctttatgatcaactccttgtatctcctgctcctatccttgttcaacaaattattcattctgtcaacttcaatgatagtatatccctcatacaaatcacgtatctgctggcaatcgttataagataaaacgaatcttccctttaaatcactcaggcatttacacagcctttcatgatcctccggattgaaccggtccggataatatttctctgcttcgtaatatggaggatccagatagaataacgaatctggcctgtcatatgtttttatcagtcgttcaaagtcctggttttcaataacgacgcggttcaatcgatttgatacatctttcaaataatccactgccttatgtatgtctctggaactcactccaaatgatctgcagtctgttccaaaactttccttaatcaaacagaagtacctagcagcgcgttgtatatccgtcactcctctggtgtttcgattcagttcgtcaaagaattgctcgcgagacattaataaccattccatctctttctgcaatggctccgggtgatatttaaccacccggtatagattgatcaattccccgttgacatcattaaagacttccaaaggagcatgtttatctcttgaaaataatagccagccagctccgccaaatacctcaatataccggttataggaatcctgatccgggaactgttccagtatctgctttctcaataacttctttccaccaatccaactaataaaactgttcatgcaataagcctcctttataatttggagcatatcacaaagattcactgcacttctatgcaaagtaacttgatggccttattgtgtatattgaaaacctgcctgacactatatcccatcttatcagcaataatctcccatcggtaacctcttatatatcggtacttaagcaaccgcttctcctgttcatcttcaatggcttcaattttatcatacaaatccatgcagactttgactttctgataccgaaaatatacaatcttttgattcagcgcattcaaagcagaaacatactttttatcatggccatgaatattcatttccttctgcaccatctggatttcttcccctgcttcttcgattgcagcattaatggtaaccagattttttaattgatttcttgtattatttcccattatcctgcacacctctctctcacacttcttaatgtattcggtgtagattgagcgtaataaatagccgttactgacggactggaatgcctcaaaatctcctgaatggtgccaaggtccactcccttgtttttaaggctcattcccagagttttacgcaatttatgaggatacactcggcatttcaactttgctcgattgccaatggtttttataacgctccggattccagacgttgacattttccaataaggtgccctacattgtggaaacataaacggactttcatcattccttaaatccagatactgcctgtaataataccgcgcttcatcatctaagaatataggctcatacctgtcattcttttccccctgaatcataatatccccggtattccagtctatctggtcaagggtgatctcaaccaactctcccactctggccccggtgctccgcaacacttcaattaatgcgcgatctctagaattcttgcatgcgtccctcatcttcgccatctcttctggtttaaaataatcaatcggctttcgaattgttttcagcggatctgttgcctccacaggattgtcactgattaacttttccttcctcatccaggtgtagaatgctgacaggaaacgtctttcattattcacggtcacggcctgattcttcttaccgccggcattaatattccgcttctcataccaggacagataatagctgatatcggattcctctattcggtccaatggcttatcaatcagggtaatcagacgcttaatggcactaagatacgcttcctttgtattatccttgattttcttcttgacgatgaaaagctgaatgatatacttattcttctgatccgtatcattctggtactctgccgggagggttgttatctcttccatattgacatttacaaattcttttacaatcacctgatgaagaatatccagaacatctttcgccacatgccctgccatagcaacaataatattattgataacctgtgctttaacagtttgtccattcataacatgtaatctccttttctataaatttcagttgcttaaggagacaatttgatttataatgtccttaagcgtaaagcggtagaagaactttggtcggggactctgccgcttgtttattgttattgattcgaatgtatgttcttttcgggttatttttttaccggggactctgccccggctatatatttaaagtttacaaatcaaacaggcttaactgtactggtttctcctgttcttcttttatcttctgttttcgtatattttccaactcttctattcgttcttccgaaagccatttatcagcatgtatcttatcaaggctaaactcttcaaaattctcatatccgacctcaagtattttcttttctaatttctcaattttcttttgcttcgtaatctggcgctgttctctttttgcactcttagaaagcttttccacatcggttgcatgagtaacctgaattccgtcttttatgtcctgcaagtcttgtaataaatctctgctgggtttcgattctgctcgaatattcaagacctctatggaataactcttgtcaaaaaattgctcggaacgcacgttacgttttaggcgttcataaatattaccagactgtactttaataaatgcctcacaaatatccatactaacaggacggtcaaaataccggatacctttttcgactgagaccgaatggtccccattgaagattgtatcatcatgccggcgacaactggtttttaaatcataataaacatttccacgcttcttgtttaactgttttccaagtatagggcaatatccgtcctgactatagcaaattttagcacatctggaaggttcataatactggctccacgtccttattcgctcatcataacccatgtgattgcggcacactctgccatggtgagtttcaacatattctttgtattttcggtctatttcatcgttgcgttctttattggccttttccaaactattttcataatcatatatttcttgggtcttatgacagacacaccagcattggatacacaggccaccgccttgcaaaccatgtaaaatctcattattatccggacaatcagctctatcataaggacaacggataaccgggcagttattttcatggctccaatcaatacccatatagctcatatcgctaagtacatggctcccttttacatacattccacagcctgttttatatataaattcatctctgtatgatggaagatattcaaatccgcctgccaaattaaaaagtggattgtctcctgaaaatctggaagtgcatatcctcacataagcagggaaattatcaaccgtgtatccctccgccaaaagctctttggtaagtaaattatattctttttccattacctatatccccatgcatggcctaatgccaaaataatcctccatgcggcttctaagagctcctactgccacatcatactcctttgctatacatttctcacagcaaggatatttataggccaggacctttgatattcgcttatcccaactgttaattggcttaccacagcagttacaggtttcatctaaccattttacttgtgccatttcagagttccttcctttcttcattcagaaaatcagcaagattcatttgcccaatcgattcccaggtctccgtagctacgccacaatgtttcaatgcttcttgataagtaactccattgttctcaattctcattccccaattatatacttctctatgtgtatcaatagaagaagttcccaggcgttgtatgcgattcggctctgcttccagatgacagccaaagccacatatgatacaaccagttctttgttctcccgttaattcatatatcccacaatgattctttcttacctctccatatacacagcaaatgggaatttcattctccattttatactgtagaacatcctgattcgtccagaatcctaacggttgacttttaatggtagtaccatcatatacgttgcaccccgtatgattgtactgattttctcgacgaaatccctcgtcctgtgtaatcccgataaatggatatctacctgtctcctttacatatctcttgaaaggttcttttttaagaatctcacagcatatgtccgaaatatcctcttctgtaatctgtttatccgctagataatgccactttttagccaacatgccaaattttccacgttcatcaccattaagaagataattgcgatacttctcgcttagttttccatgtcttaactttttaatcttactggctgtatctttgctgatcagaggaaatcctttatgctcacacacccacttgaaattatgttttgggtacattatttttaaagtaatagtcagctctggaaattgggttttcaaccatgcgacatattccttaacaaattttctaatctccgggaattccactccagtatcacaaaaaaccaatggtatctctccggtcagtccatattctcgataagtcatgcagactaaatgagccaacaccgtgctatcaagacctccgctaaatgctatgtaaattaatccaccccaatgttcgtgccactgtactatgcgctgtgcgctaaaagatggttttatctcaaatggcatatgtttcatattgacaaacgttgttttagggaatttcaatccttctttaagcaaatacattttctcgaaaggagccgacacgtgtctcctggccagaagctccgacctcctttcattttgggtaacaaaaaaccaactaccgaatattgatagttggtttttacaattatttcttacaaatattcctgaacttttcttcaagcgcctcaattgttgcttctccgttatcataactcaaagtatatgatccaccatcaatttctttctcattcgtttcaaatgagagaagtgtgtctaagtcaaattggaaatgaaaataggcatcttcaagaaatttctctatttcttcttttttcttctcgtcggcattagcatatatgtacatacatgttgctgctaccgctgtataaggatgctttctaataaaatcagcatctgccattccgcaagctccgcctctgtcacattggaatacgtcacgcatgatgtactcaaacgggtgtgcatatgcttgaccattaataattctttgctccatttcttatcccccttgtataaaatttgataagataattatacaccaccaaccatcaatattcaattatcaaggaacaatatttcttttaaatcctattcttttgaaaacaatttttccagtacgatatcgcaaatagcccctttatcctcgtccgtccagcccacaccattttcttcatactgccgctgtttctcttcaatttcctctgacgttatttcttctgccagctgaatataatcttcttcggaaacatcagcaagtgcactgacacagcataaagctggcgtttcaaacggttctgtgcaataatcaattacaccacagttgccacaatgcatatctaattcgcctatttccataatgcttcctttcttccactgctaagagaattccagattagacacttctccttgttgctgaccgaaacatcattagcaacatttctggtaccgatctgtccctgtctttcctcacggctttcttgacagattttaaatcataccaatcgccctgataattctttccatcaggaacatataccccgattctgtacggtatttcattcttcactttttcgtatacttcctcaggcatgacataataattgaaatcgcccaagaaattatgtccgttctttgaatgaaaatcttccaccgaggacttcacttcaaagcagtagaagtcccccttttcaataccagataccgtattgtttactggtttaaatttcatataatcgacccggaccgcattactggtggcatagtcaaatgtcacttctgccgcccagtaaattcttgggtcattattggggtttatgtgcttctggatagacaatgataaaaattttgtaacctctggcctactgctcatagctcacctcttcaaaagccttagcttattaattcaaaaaactcctccaaatcctttttagaaatttctatccagcccaaatcctctgctccgcttgcgcattccagatgaatttcaccaccaataatgcttgatttatcttcatgccagatagaacctaccggcacaattccgtattcattcggaatgctgaagccgtccccatctaccttttctaagcacatttgctttatacatttatatttcatgtctcaacctcctgatattcttcaatcatattaagcaaacctaagctgctcctggctatcatcaatcctcatgttcggcattcgttcccccacctttagataagggcaagctgtataacaaagcttctctgccatcagggggacaacgctgtttccgattttctcaacctgcattgttttaggataaggcttaccattcggcattttaaaatcaatgatataatcctttggaaatccctgtcccaatttcagttcttcaggcttcaacattcggaaccatatatctatgatttggtatgttactccatctattaccacaaggacaagaccaaaccggtcctttgtgacaatcgtatggattggctcgtttaaactctggccgatgtctccgctgtaatatttaatcaagaaagctgacaccaaagcaaaatgcccaggagaggtggttatcgtatggattggctcatttattgtctggcccgttcctgtcttataaaacttcgataggaaacaggttacaagagcataacggtttgcagtatcaatagtctgtattggctcctttaaactctggccccggacctctccctttactgtttcggaatgatattgtattaaaaacggcgccgccactttgtccggaagaataaaccggttctgatcatcaattacaaactttttaatcccggctgcgatacggctcagtgtcttatctttcaaaggccgtttcctagtaaatatagggttgcctaaatccgtaaaatcaatatcctgactaatcggctcccaaggctttaggccatttacaccacctttagaatgtgtctgctccggccaaacaatcggcctaccatcacacctaaattgtccataccagcgcaccctggctgtatgcgctccataatcagcagaatttaaaaccctgcattcaaactcatacccaaaagctttcataaggcgaataaatttattgtaatactcactttcacgggccttaatgggcttaccgttcttatctagaggtccccatttctggatttctttaacgttttccatcataataacttctggaactttccctgttgcttttaaaatcagtttgcattgcttccagacacccattggaagtattcgcaatcctctttctatgggcttatctccttttgcattcgaatgcgaggtacagtctggacttgcccaaacaaagctaactctctgcccccatgaaagaaattttccaatttttactctcatgatatcttctggaaaatggtgcgtatacgggtgattgtatttgtgcattgatatggctgaaggactatgattaattgcaaaatcgaagctacgcccccaggccatctgtccaccaacacttacacctccaccaccgcagaagtagtctataattacatctttcatttttcaaaaaggttccgtgtacactctcccggccggggaacggttcctttcattatttttcaatcaactcgttccattggtactgtatgtagtgccattgtttttccaaaaagccttttattccaggcatgtccttttcatcaatatgcttaatccataccgggcgataaatcccttttctttgtagcataaagaataaccaaagctcaaattcagctatcggctcatctgtatctggattgtgtttctgctcaatatcaaagcgaaaacatagattgtagtcaatatcaatgcttacgccgtctgaatcaagccattcttcttgaaaatctgcccacgtatcatattcgcatcttccgaaattttcaccatgctgattgccgacataatgattgctttcgctacaataataactatgttctgtggcctgtaatttcatttttcacctactttcttactggctctccaaatccgctcaagttcttccagcgtaacatggaccaggagattgcttataaaactacaattgctatattctttggacatggctccaatcatgtcaacaagaccattccagtattcatctgtatcattcggttcgctgtacttcttaaacagtttccatgctccggtaaggcattcttcgtactgcttatccagaagagaagtgcccccagctttaatcctttttatttcttgccagaccaccaggcagaacagcctactcatgacaggattctcatgcttctttatcatttgtgctacatgctccggtcttaccatctgacgattcttcataagtttccaagcgtccgtataagcggaccagtatttcctaagttcaccttcgttcatatcccaccgcctttatactccgctcacaggtaaagcaggtctcatcaccaaatcttccgtcataatgcttgcaggtaccgcagttcttcctggtccaccgcattattgtctttcgtaaaaacatatgtaagttatatctcatagccggtatacctccgttattcacagaaaaccggaatgaaaaacgcccataagcaattaagattcttagtaatacaaattccaatagaaactacagctgctacgttcacccatttaacccaattcttcaaatttctgtctcctttcatactccttcatcattttgatttattatacttcacatacggatattattcaatattggataatattttaactaattatttctggcataaagtcaaacaatgtaggtgtatctatattgtcctctgccgcctgcaggtatccaacgccatctctgaaataatccggatttaattcgattccatatcctctccgacccattttaatagcagtcataggaaccgtcataaggcccgcaaacggatccgctacaaggtcgccttcgttggaatatctgttaataattcgttctgcaatatccagctgtaaagggcatacatggagctgtgctcttctccggctctgtgtagtatttaaggtgcgcatacggttaatatcgtcccatacttcccatgtccagcttcccggcgcaaccaccataaatgtagctgggagtttaccttccgtatcaagtttcttagccagctctacatgctctttataatcataaacatggtccctgctatattttcgataaatagcctgaagattctttactgaaacattttctaattcctcttttctaataaggcggtcacctgaagatctccaaaatccgtgagcgtctatctgccattgcgccctggtatattcttctttggtcttatgaacagggacatctgcataagctgttgatctgtcagtaggtagttttctaaagagtaaaatatattctggacaacctgctcccattttagaaccgtctttgcattgctcggtccacccaagccggtatgtttgattgttttccctcaccacgtctgtaacaatcgtaatcatgccaaaatactgaaagccatgtttcatataatggctaatacaaagtgaatgaaacggctctacagttggcattccggtccctgttgcatttccgaaaagcacacggtccttaacatgaatagcggccactcgtccaggttgcagcattctaaaaagttccggtgtaaggaaatccatctgctcaaagaatctttctgtatcttgattatgcccgaaatcattataattggccgaatattcgtaatggtttccgaaaggtattgatgtatgaatcaggccaacactgttactttccatacgccttgtttcttctacgcaatcatcgtaaactgccgtatacttcttccctttgaccttcactgtttcaactcccatcttccgctccaagcgtttttctttccctgctgctgacaatccatactttctcacaatctcaatcattttttcaaccatgtgattgtgattcttccacttttccagcaatacgtcttttatttctctctcattttccatgtagataatatcaataattaccgacttatcctggaggaaacggaaacatctgtgaatagcctggataaagtcattaaattcataatcgatccccagaaatatttctctgtgacaatgtttctggaaattgcaaccagatcctgataactctttttttgttgcgaaatactggcaactgccctctgaaaagtctataaccctttgttccctggtttcataatcctgggaaccataaatatcaacaactccaggtaccgctttcttaattgcaagtctctccgcttccaggtcatgccatataataaaatgagcctccggatcagattcaagaatctctttcatcttctccgttctaacatcaatactctcacgctttacctgcgctgcttctttcaggccggccgccgcttcgttaaataactggaactggccatctctatctgctgtgtctccgtaatttataggaagttcatgccaccttacatctaaaggtggaagaatatatccagcatctgaataatctggatttacatcagaaggctttgtaataaataatgcccagctgctcacccataaccagaactcatcttccatgttcgggtatagggttaaattattggcctttgtagaatcccgctgaaagaaccttgtcaaagcctgcccggtatccataactcccaaatatcctgcgtagtgtatcagttctttgtatttgttcgggctaggcgtagccgtggctaccaatttatacggaacctctttgaacttgtccaaaaaggtttgataagtcttacttccaaagctccggaggacgctggcttcatcaagagacgttgccgtaaagtagcttggatcaatatctccatcacgaacacgttcataatttgtaatcagaataccggcacctgcagcttcaacttctttcatagtcctaacatatactggcttttcataaccgagaatattttgagcatcccttatgaattcttgcttaacacctaatggacaaacaataagggctttgccgccaaactttcttataacctgataacagaattctatttcctgaacagtttttcccaatccgaaactttcaaataatgcccgacaaccgcccttcagagcccatgcaactgcgtcactctgatgaaatttcaatgccttgttgatactgctacgatctactgtaaaacccgtatctgttgcaatctcaatcttggatttcaaaaactttaaataatccattttttcgaaaggaacccggcgcgcctgttttccggaaaggttccggctcctttctttttataaatcaaatttcagttttggtgactttcctggctcattccgaaccaccttacaccacgtaacggtatttgtctgttctttccatctgtcaagcgaaggaataataaatcactcccaaatctcacctctgtagcttcaaaatcctccatataaccatcccaccaacggacagtaactttattattttccatgttcccccttcctccggctcagccggatatcccaattttctttatttattagcattgcttttgcattattaagtttattctatcagtttcggctttcctccatgggtggtctttggcagtaaccactggttttgttgcagcctgatccgctggaatccccatctgcaggcggctgtatagagtgtggtaacatatcccgttactttctgcttgaattaccaagtctttggggattaccctttgcctcgtctttctggttctttcaatgctttccgctctgctgaccagtggtgtaactgctgcggcctccagcgtccagcctctttgtgttctccgcttgtaggtatttgcaccaatcccattcttttctgctaattgcttatatatcttgtattcttcactcgttgccattacaggggcagaaatggcatcttttgctttccaccccattgcaatcctggaattaaccgtctgcctgcatattcccgattttgcggcatttatgtaatcatcaggagaaacataagtcccccaaacatcacgcgacattccgccacctcctatccgcacaaactggacatgcagtccattgctttattcttatctttttcctccagctcccgtatgatgtggatatatgtatcctgcgttgtagtgacgttcgaatgtcctaatcttttagaaacgctcggaattgacacaccggcagcaagcaggacggaagcgtgtgtatgtcttaaacaatgtgcggatatcaccggcacgcctgcctctctgcaatatctttccagataattattcaaggtagaattaaatatccggtctgccttatcaaagaaaaacggttcatctgccggaaatcctttgatcaactgctcaaactgttctgccaaaccgcaatctattgttacctcccttacagaggattgatttttggtaggcatgaatcttccatttgcagatttataattccaggttttgtttacccttatctttttattggcaaagtcaaaatcattcggcgttaatgctaacccctccgcaaaccttagtcccgttttagccagaagcaatataagccaatcgaatccgacccgatcaggatgaagcggcaacacattcagcagtttttccagttcatctctgttgagatatttcattttcttttctgccggcattttcccccggattgctactttccgcgtagggtcccgctctattaacttttcgtcgtaagcgtccaggagacacgctttcagctgacgatgaaagtccatgactgtctgcttttcatgcgtaagcgcatagtcatttattaattgctgatactccctgcgccctattacttttaaatccagtgtaggcgccagttctttcagccgcatatatgtcatccggtactttgacaatgtcacttctgccaccgttccggctttgtatgcttcgaaccaacttttaaaatattcatagaaaagcattttacactcctccctactatttgttgttccacagcctttccactaggtcctgcgcatcgtacaattttgttcgccctctctcggttaaactgtttagtacaattgtattccacacacacaggccgtctctcaatactcttaattgttcttttgttataacaaccttttcatcagcttccatatgcgttcctccttaaaatattaatttaacaattttgaatcttcttcccgcaatccgggcatttcccgaatgcaccatcatttactggctgagcctgaatctgtttttgcaaagcacttatagccatttcaagggccatcttctctttcacagcatttattcccggctttgttatggacaagccaaatctcatatttgcaagggttctttccgctaaatattctgtcatacctttactcctctctatcctgatttttaattctcgattaaaattcggctataatgtttccactattatctaaataaatcaattcataatgtgggtgacaattctctttgtgacaggttccatcaaaacatatatccaggttcatactgtcatttgaaccaacaatggttcctttaatatttcctctgcttttggatttcaaaatcaccttcattcccatgaacgcaaacgtgatattacggtattctttcatttgctcaaattgttcaacgtcaccaaacaaatcacatggtctgaatttatggaccagtcttatactttttacaaatcgtaaaaactctgcaaaactgtcaaaaaaatctcccatttctaagaaaaaattatacttagcttttcccggtgtttcaccgtaagcagttgccggcatatcatatcctgacaaagtaattacgtaagtattcaaatcaccctttctcctctcaatcgaagggaatctcgccctgctccacattcaggaacccatcatctgatttattccagccatagattttattttcggccggataattcttcagtcgcttggtctcctgctcataatgcagtggtacaaaatgatcctgtgtaccaccatcacgatcctttgcgatttctattacgttggttgcgttgaataatgggttatcatctttccacccgaacatctgcttgccaagtctcttaaaatcattgtttacccggtggactattaaagcattgtcaacggcattccccagatccgcagttccggaaatatcatctaatcgcaggaatcccattgcttttcttgggtgtgccacgaatagcacatgaacattatgttttttagcaatccgctgcatatccagaatgaaggccgtctgtgcttcaaatttgttatctgataagcaaaggatattgaatgccattagattatctaaaatcagtaagtccagtttcttttcctcaatggccttctcaaattgttctgccaccgcccggtaatcattgccgtaatcgttgttgtacaggtagaaatgctgccctagccattctgcaatttgctctttatatttcctggagacgttgtaatatccttcaaactgcgtaggctccgtatacccttttccggctgcctgcaggtccatccacctcatgaaattcttaggagccagctccccagaaaagataccgacattatttccagattctacagcatccaatgccatttcagatatgacactagatttgccggaggctctcaaaccagacataactgtaacatagcttttcttcaatcccctaagcttcttgtcaatgtcagcaattccgcttttaacaaaccgttcctctggtacctgcaaatccagaatattcctcgctgtgaagaaaaccggattccctagaaccggaactatactctgaactggcctttgctgaactggcagccttgaatagatcttccgttcatactcctgctgccgcttctcataagcatctggctcaaatagttttctcacgtcctgccatgtcttatccgaacacgaattgtgaaagcaatgaaatccaatggctccggaccgagtctgaaaaatgcaagcatctttccctttatggttgctgtcaaaaggacattcgtccagaatgaatttagtcccgtcactatagctggcttttctgtatcggatattataccgttgtagccactcctctaaatcaaactccctgggattgtaattgttatacttctgaggcttttcctgcttctctggaatcattgaagctagcttttccaggtatatcctatctgttggctccctgctcccctctgaaagcagatggcttagcctgtggggattctgctccgtgttactacccttacgggccatggtcccatacaatttacaaatacgggaaggattaaagtttgtggtatcaattttcagttcatcatcactgaaaaacatatccagcgccgctaagcactttttaaccaaagccttgttttcctcgttattggcaatctgtatccgataaagcaggtgaataccgttaccgctcaatgccgttaccggatcattgaatccaagattcctcatgaacacataaatcttattgccacgttcctttgccacctgtaactgctcgtccgaactagatacaccggccggccgttgaggatcaacatctatgaaaagccatttataccccacaacatcattgtcattcgttgtattcttagcattcatgacgaacttttctcgctgctcccgtgaataacaatcttcttttacctttcccagggttatgtaaatattgctgtctgtagaattcagcctacaaagctggtcaatcaaggattcctgagatttaaagtatccgctgtatactttccggccatttgcctccagacaacggacctcaaacaattcaccctctggctttagtacgttgattgtttttcggatttcatcaggtttgaatactttctgtcctactgccatacctctccaccatcatctacaggttccggatcttctggcttgttttcaagataattaccatcaagcacttttggaaagttgtttggccggataaaccaatcaaaggtaatgacccagcctcccttgctttgcccaaggaggaacgggctatatcgaatgttttcgatggcctttagaacatcatcaattccataatccctgatccgaacttttaaccattcacagcgttgtgattccgaaaccaatcttgttacatgcttcactgctggcaaagagttccaagccccaatgacgcgttgcacgtcagtgctacgaacagtatcgttagatactgtattattatctggttctttatttggtttattatctggttttatatctggtataggtcggacattatcgccctttccattggacgtttttgtctcttccattggacgtttttgcacaatggataatcccttttgggacaatgcataccacaaagtacgatcataggcattctcattataatttccggtaatgataacttcctcttctcgtaaatgtttcagcgcattctttatctgccgttcagatacataagagaataattcattaaatgcccttgtgctgttatacgtccaataagtaccatcaaaaaagttttgttcatttgcacgattcttttcaatccaataaaaaatatgattgaggagaactgcttctaaaatcccatattctcctgctatctcagagtcaaaactatgtgtcatatttacaccctcccgtcaatttccacttgcttttgagatttcttttgatgatatcttaaccgcgcatattccagtttcctttcagcgtttctttgataataatcactttgatactgttttctttcgctggaatgcgattttacatatttccgacacttttttgtatttttatccgtatcatactcagcccgtcttttatccagaatttcttgccgatacaacttataataagattggttatactcatgccgatcaacatattttctgcttgttctttgggccgccgtttgacggccactatagtattcctttccagcatttctgtgcaattttttaccattccacgcttcaaaatgttcgtaatctcggctattagactcagagaaatcttttgtttccaggcgatcatatctgcaatcaatataagggcaattaaagcaatctggataacagcacttaggaggtcttttctgcatattcattcactcctaaaagttctaaaatcttagccccggaatcttccggtttgcagaaaagaaacttacaaccatattttaattccatagtcagacaagccttttctaaccattctccggtagccgcataaggatatttcctgaccttcttatatatgggcttaccatttttccaaaaacccaacatctgattactgttaaccaacttatcaagcctgggattatgccaatgaaataaatcatctaaggaagtaaccttgtcttcattctcaaccaaaatgtaaagccgtattccactattctgcgcccttttaagcccccggtgaaagaatccgtgtcgcttaacataaagagcctgaaataagactatgatgccctcaggtatggcatatttgcagcaaacctcattaatatctttttctgcaaatcgatctgtgtcatcatcacaaatcgcatgatatacatcattagcaagatcaaaagaaattcgcttattttcacagatttcatacactttatctttcacttctttttttggcatttgcttaacctggatatcaccgataagctcatgaatatcttttttggtgtctatacaaacactctgattagccgggagagtataatccccgcaatataaagctgttcgattataatgaattccaacacgtcggaagtactcatgcttagtctcatgcttcttttcctgctgtctggtatcttccaaaatcagcaaatggaatcacctcctctgggataataggttcgctcactttcaagccatttctcttcttctttctgatccctaaccatgctacgcaatttgtcaatgaaggttttatttgccttgtcagagtagaactttgcaatccgctcaagcttaagagatctgtctttcgccgctctgcgcctgttccggctgatattgaattgagtggctattttactccgctctttagcgttattttcaaactcaatagcatggacaaagtcctgatgttttttatcttctgcgaacatttccgtacaggctgcctgatattctttctggcagtcagccagataatccaggaaatcttttattacttcggaaggctttggttcgtttttctttttcacatgtggcaccccctattagttaaaaggcaagccttcgtcttcaacgccatcaggaatgttcatgaatccttctccaatggagttggacggctcaggtctgcttgtggcctgattaccgccaccggaatcccctgaagaagcattcttgctgtcagcaaactcctgctcatcaacaatgatatctgttgtatagacctttacgccgtccttatttgtataactgccagtctggattctgccagaaacaagcaccctcattccctggcgaaaatatttctctgtaaactctccgcctttgtcaaaggctatacagttaatgaaatctgctgttggctgtccttcctgtcgcttgctccccctacgatcaacggcaagagtatatcttgctattgccatagcacgttcaccctgggaatatctcacttccgggtcacgggtcagtcttccgcataaaatcactctgttcatactatgtccttctttctccgccggcccattactgaaccggcggtaatgatgttatgaaatcactgtaaaatgaggtaattcttccagagcaaagccaagatattttttgatatttctcatggcttcattcttccaagcgccgccatcagcttcaaagatggcacattctacaccattattttgacgcatacggaatataaaggcgctctcgggctgatccacttcaacgaaggtacggaacggtttcaggttaaccggattcggaacaattgcttcgccgacagaagttattcctgtttttattgtagctttttgagtaactccgtcgtccccgtattgagcaatagattcatctttcacagtaccggcaaatcgtaacagcaactcacggtctttgttctcaatgaattttgactgtaaagcaatgatgaaactttcatgatccatatatcttccgtacccaaattccggaatcatggctttcacacttacaagacattcacgtttccgatctgaatcaaggcaggaaatcaatttgacttccgtaggggacaccacctgcaccaacatttgatctgacatctcaacagtaaatgacttggcatagtctaccaaactggtaagagtattcatctcaatggcagccgcacgaagattattgtcaacacgataaatctccttatcggtatatttatctccgtaaatatccaggagctttgcttcttttaatccaaccacatattgtaatgcttcttttgacatatccataattcatatcctccttaagcctgcttggccgctctcaaatcaactactttgccatctgattcttctttgatttctccggtttcaggatcaacaatctttccatcaacctttaaatctccctgcggtgtctggtaatcttccagagacatctgacctcgtagctgcccgccgtactcctgcgcgaaaaccttaccggtctttaaatccttaccgattgccattctggtaacgataggcttaacaggagccagctttgtttcaacagaaatgtttacttgagtatcatctctgtcctcattctgttcaaaagtcagcttaatggtaatagctcttttgtttttataaggagtattgggatcctgcatattctgtaacaccttttcttgtgctactgtatacagttcctgcaaaccgccatctgccagttcttccaactttacttttgccatgatattttcctccattggctcgattaataagttacatttatttcaacccgggttaaaaacgtcttatagttttgaatgggatttcgcccatatgaattaactcaatgtaaattccggcttctcttccggttcaatatcatccgcacattcactttccgtatccagaatgattttaatgaatcctcttttcaaaacagagaggaatatttcgaagtcactgacatttctcaatgaattgatttcaatggaatcagaacattttaaaatgccccatttatcctcattactatctttgtagagtttgacttggcagtttaaatcttcatcttcatcgcaagagaatttcacaaagcaatcatcaaagctggatttaaaccatcctttatcctcatgttctactaccatgtttgctgttacgttctgataatatggctctccgtcctcacagtccgcttctaagtcgcttgtatccacattctctgatacatgcttacagtaccgttcaaagatatctgagagcttgatttccttgtattccggttctttcatgatagactggaaattttccaacattttcttgttatctatcaggtctgtactgcttacaatttcagtaagacaggaatccagtttcacaacatactggttaaaatcatgctgttcaattactggcagcattacttcttttactttggcttcaatgacctctttagctaccccacgatagccaaacaaaccgtcaagcgcttctgaaatgcctttctttaacttttcctcaatgattttttcaactgttccatcattcaacttttcattgagaacactaattattttttgctcaaaagtatccatcttctactccttttccaaatcgtaatatatcaactcctcgttatcaggcagcggacattcatcgtctttccataccaaagatttaatgcttgaccaatgctttgtgccggtatcatataaaccgataatgcttagaacttcctcggtatagcaccggctgtcaatcaatagacggtcagaacggttatgcttccggttatcaagattatccagaagaaatttgtttagcttacggacatcactcaaatctttctgtgacggtttatgatgtaaggtatatgtaattccattcacctgccgcaaaaccgctctatctgcccatctcgccgtcttaatgcaggacgtataaagccaaatcttacccttatatccgtttgcccagagacggtgaatcatttccactacttgaggggcaatttccattggttcgccgccagtaatgaccagctccttatatttcaataaatccttaaaattgacctccggtacatcgcctatatgctcattacagcaatttggacaattccggggacaatcgtatgtaacaattactctcgcaacgtctttcatgaaactcctttcatcaaaatggatctttatttacttccacaacaagcccaggtaccgcacaatccacattaacgttgcggccagtctctttctgcatttcattgataaaatacttaccagcactcgaaccggctcccagatggcacattatgacggttctaaggtttggtgactggttcgctttaattgctccaatacaggtttcaagggaagcgtgtcccaggagcttatgttcgtagttcgggatctccttatcaatgaactgcacctgataatttgcttcaataagaaagtgctgaatctgctgttttttaaagttgtacggaatgtattcataatctgtggcaaatagcaatcttcccatttccttatgttcaattagatatccaaagttcggtgttccgttatgtggaacaaagaaaggaataactttgaatcctccaatatgaaccgctttaaactctagcacgttgtaaaactgtgctccggggacttctcccacggctcgttttgtttcatcgttggtatataccgggattccggcttttagaaaatctttagtattattagagtggtcgcctaaccatgttcatgagatagtaagcaacccttaatctttagaatttgccaatcaatggcttttttaacttcaatgaaaggttttccgcattctaacaggagagtttcatctttaccctgcaaggcatatgcgtttccttttgaaccagaggagatacatttcaagaacattacatcacctgcctctctactttatatttccaaacatagcctccggcagattttctagttctccctggcttatattcctcaccgcttgctacttgtagaatgtttctttgacacactccagtgattttttcagctatgatggaattagggaaacaagccaagtaatttccctgtttatcatacattaaaacttcttttggcttttcatattgattgtagtaattaataccagtaacaatttgtgggtgttcttttaaggtttctttataatgtttcattgggtgaattatttctaagttagaaaccatattgttttgcttgtttccatctttatggtgaacatggtatcctttgggtatttctccaataaaaacttcagcaaccattacatgaatccgcttcgtatgtcgcttcccaccttgatccagaagatttacagtaaaataccaaccatgctgattctttagtgaaatgattttcccatatttatcagaacagtaactttttaatcttcccatattagaaatagaatagcgtccttcaaatccgcttatccatttccattcctcagtcattaaatcacttccttttattgagggcatatccgtttcctttactggaactgccgattacttttaataccatatcaatcgaccttttcattttgggctaatgaccattttcttgcattatagatagtctggcagatacattcagctacactgtttgccacttcttctttcccggacaatctgcgaacatagttttcgccacacacaaggcaggtgatttttcttacacattcctatatcttccaaactgtatatatatcaaatacctcggtcattttcccggtatatccagagtttccaaaccacttatgccggacctctgccaaaacggattgagtatcttctctgattaaagtaccttttaattcttccttgacctctgccataatttcggcttttaactgttctttttcctcggctgatatcattcttccacctcgcttttctctaaaatttgctttgcttcccgaagtgcaaccaagctaaaaactcttttcgaaaagatacttttaaaggaatcccgaaaccaagcaagtaattcttctttttcaagacgatttacaatttcctctcttgaaagaaacaatttatgctccggtgagtaatttgaatgttctttgaaattatcctctatctcaaatcgaacatttctcgaataataaccaggagaaacagtgatatacttgttcccgattccggtaacagtggcttccattataagttcctcaccatgcttacccctggcggcattgcacaaaagtagcagatacactgtttggcctttatggaaatcttctttcttcattactccatctcagcctccttctctaaatcttcaagataagaatctaagtcaaaataacattcatctaacccatctgcacacggcggaaagattgggccatctgggccaccttttacaccacccgagcaatccagactaaatgtacaatacttgcaaagtacttctccatctaagttgtcaattattttttgtgcttcgctcattcctccacctcaatttcctcatctgccgggaagcggaatatctggggcagcatatgatattcaacgcgcccatcaccttgacttggcaccataatctgaccgccaaccatggattgttttaaatcctctaagtccgtttgggagaaaccacaatctgaaataatcaggcttggcattatgccgatatactccctatgtaacatctccatggctttctgaaccttttccggggaagaatattctcccatgaggaatgaacatgtactgctattagttgaaggaatttcagctgttatcatgccacctctaacggatatgatacactgctcatacggagcgtcatatttaccattctgcgaaacaatcctcatgacaccctcctatgcccaatcaggcttctgcggctgagctgccggtgctggctccggtttggatcctgcctgttgatctggaacttcttcacctgcaggtgattcttcctgttcaaccggctcctgctcctctggcattggaaactcctgagcatttgcgtaactctggacatcatgggcaacatcttctgccactacatctacagaatcaatatcttctgccttatcagctgcttcaatggtaaacacatcaccatattgctgtacaatctgcttgcaagccctggaagtaactgttttcttaaccatcatgtcagtaaattccgcatgggttccgctgttttccttatagccataacctttcttccatgctgtcttaatctgattaatattcatcacttccatgtatgtactgccgtcatcaaggacaactatgcaataggcacctttgattttggtcagatcgatattctcaaaatcctgtgtatgctcatcaagaatctttcgaccattttcaatatggtatttgaacgtatctccttcatagataacctctgcattaatatctttggcaccatatctgtgagccatggctttatgtccatgataggatacctgacactgcaacttcccgccgtaggctattggataacactgccgtttctgcattgacaggcccattgtcaccatatccatgagtgcattagcaatgctggcctgagagcatgtttccagaacatatttaccgtttctatccttcgtctcctttaaaatgagatacgctcccattaaagcatttgttggattataatctgccgggaatgtaagcccgtattcctgcttctgttttagctgcgcacttaaaccgtcaataaatggattatttacaataagagctgcctgctgtgttcctgttgccatcacttcctgttttgccatatctatttctccttttccaataaataagttgcttccatatccgcttcatgcaatgccaggaccagaggatacttctccatggctgtccccagggtattccaaagttcttttggctcatatgaacccatgtgccaacgaatggcatatctttcagccggtaacagttttatgtattcctcaatcatcatgacactcttctcgccatgcccgtagggtatgaggtcattcactgtataaaagggaaccgacacccaagcaccggattcatcttttttgttccgcatttccgtggtgtagaaatatgttttgcaaaggtcatggagtaaagaagagattacaatactttcactctgtacatttactaatattttgtgccaaatagcattgtagcttgctttcttctctgctaagcattcaagaacattaatgctgtgttccaacaaaccgccctcatacgctccatggaatctggtactggccggagccgtataaaaatcactcttgcgaataaattcaagaaggttttcaattcccggacgctttgtttccaataacaacttttcgaatctttcaactaattcctggttcactgtttttctcactttcttttctgattgccttatgaaatgctcccctgtcaagccaatgcaagacagttgataactgcgtatgtttaatgacttcaatgtgccttgtctggtgataccacataacccacttttgtttcaaaagttcatcaagtgatgtgattggaacaccttccataaataatcgtttagatttcagataatccttgtgtttcttgatattttcacattcagcacaaggcgattcgtaagacgggtaatgtttgccattatgctcccaactcaaagcacaatatctacaaggattctgtttcataaatcctccttaatctcggtcaatcgcaatatgaccagttgcaatgagggcagccagtgattaactcactcccggccttttcaaccgatatccccttggataaatttccgctacgatttttaccttcagcataaatctgctgattgcatctccagcaaataccactttcgggagcgaaataagggtagttatactctttacaataatgctcctgtgctattctggaagaatatacattgaaatgctcattggtcatacttcctgtgcctcctctgctggctccttgccatcaataaccttgatattttcctcaccataggaatttacccattccatgtcaattttcccatcaacgacgatcccatggccgccgccgggcaaaagaaccttgtcaccggggactacaggttcagaggaacgaaaagtgtatgtaccgccagatggttttccgtttttgatgtaccttgctttaattaactgcatttagatttcctccatttccttttcaagactcctaatttgctcatcaatgatacttttaaattcattgattaatcgcttcatgcttaaagcaccaaggtcagtattgtcggcaatcactccactcccataggaaagtctaaattctacagtgtagcattccggcggcagattgatggacttttttaaatcattcaaatgttttatctgctgcatgattggttcagctttttcaaattgtgcttttttcaccttagcttttcctccactttttcccaacaattcagcgactttattcagatgtaccatatcctcatctgtcagacgattagccaccgcaattaatatttttattgcatgaatgagctccgatatacgaatctgactgtcattggtcatcatttaatctcaaccatcaactctttgttatcagctcggctcattacgattaattgactgtcacataccgggagccgccatggatcaaggctctccccatcatcaagaataaccggacactgaatacccacgattttctgaatggtcagggcgataatcatcatggcttcaatcttcctgccgtggttcgccgtattgtcatggatctcatagccgtcaatccttggaacacaataatcttttttatatccaccgttcttagcaaaggcaaataaatcccatgtcaccctaccgccgaagtagctgttaattgaatcaaccaaaagttcatttttcttttggtcaagctgatccagcaaatcaaggattctttcacaattagcctttgactgttctttctgcaactgctcattccgcaggaaggttaacctctcttccagttccacattcttagccattctggtaattttctctttcacagaatccagttcggcctgaatttcggctttctggttccgaagcgtagcccgataatcggcacccgtatttacggcccttaaagcttcttcctttttggcaatctcctggcaaagggcttcatattcctggttctctgataaatctatctgagtggggagtgcattcatttcttccagcgccttattctttgcactattggcagtaaccttctgttcatttgcagattttaaacggttttcgacctcagcaagatcaatactttccagattttcaatgtccgcttttaacgttctgcctttttcagaaatggaagttaaaagatctaatttccgctgctcccattcctttttatcattatcatactgctgacggtgtcgctggctgtttacctcatactgttcctgcttttgattcttaactgactctggcaaatcctgcccgcaagtagggcaaataaatatatcagaacccaaatcaggtagtggcgtataagaaggaaaaacattctgtgaaacattggtgtattcaactaataaactggccttctgctccgtttttcgctttatagcctccaataccctctgcttatccatttcagccatagttgaatcattcatagccttcctaaactgcatttctgctgcatcaatgcgcctttggatttctttcttctgctccattagtttcgaattgcctgtccgttctatttccgaacgtttaaactgtaattccatgatatccttggtcctggaatcatgcagtttagcctgcgcaagtgaatcttcttcctgcttttcgatatttgaaatttgatgctgcaattcatttttctgtaattccaactccgcagtatcaatgtcctctacgatttgacgattaacttcatcaatacgaccaggatacccagctatctccttattcaatttcagtacactggccttattcatggaagaaatctcatcaatgttatacttctcaagcaatggtaccagatctgcaaattccgaatattttttcacaatgtcgttaatggaaatatcctgcggcagcttgaagagaaattctctcatttcctttggtttctttgccaggaatgctccgatattcatgcacatgagcagatcgtcgaaatcaaagtcaaaatatccgatgaaatcttttaagttcttctccacaccattgatggaatatgtattatcatcagaatagctaccgtcttttttagtggtccgtttctggactttcttcgcaatgatttctttcccatcaacttccatagtgatttcaccgaccaccgggacatctgccacagggatcttgtcaacttcccggcgcaccttcggattactggtcaggtcattgcctaccccatgaagcacccacataagcaattcggcaatgctggacttacccaggccgtttgcacctctaatatgggtaatcttgtccccaaactgcacatcaaagcttttgaatcccttgaagttttcgcagtgtgcactaatcaactttactacatgcatttcaattttcctccctcaaactcttaataaatttctggacagccaaaatcatatcatcttccaaagtctgatacggatccgtccctttctccggattggattccggcattactacctgcatttcagacgaattttcttccatttcttcttgcttcaaacgataatagagaagatttaacaaattggaattagtagcattatcaatggataaatacttttcaaccaatgaaagtttcccctttgttactacaattccaaacgcatggcggatagctctctcaacgccagtaccggttgtgttatgccttttagcaatctcttcatataaggccatgattttaatgccacaaaattcggaatcaaatagtcccatagcttcagctatgtattcaagcccattgaccgaagctggcattcccattttaatcaaaatatcttttgctctatcttttatcatcttccggtacctccatctttgaaacggaaacctcataagcagtgcgctttatttctttcgtgtcactgagtttcttaatgtactcccggctctgaattcttccatatatttccagtcgagtgccgacaaaaagccctgaggcgtattttgcgtttctcccccatgtaatgcaagggatataatctgatttggcatacggacggtttaccgccagaagcaaatctgcaatttctctccctaatggagtttttcgataaaccggaggcttgcacaagaaaccatttaatgtgattaaatttgtcttggtgtaatctgtaaattcctcttccaaaaaattaacttctcttacgaacaccgaaagaataagtctctttctttctggtccagactggttgtaagagcgaaactgtccgatgacctcaatcgtgtcacccatggaaatctcgtttttatcaatcaggcgttctgagatcgtaagcggaataatgtcaacctgttcactgagacgcttaacagaaaggtccactgtatagaatccttcaccaaacacctcatggctgtatgtaaatccggaaacaatctctccgattaatgtaacagtattattctgtatagtactcatattgtctgttatcctccttatttaagttctaaatctctttttatgttctcgtacatcagttttaaaataagagcctgtgccattttattttcatttgcctttttaactgtctctgaaaccaaacattcacagccaaaaagtaaaacagatacatgtccctccattttgattttcgtggttgcgtccattccatgttctttctcaaaagaaattgtcgcaggtgcttcgcttatttctttattccggtccgtcatccgctccataagaaccgcttttaataattcatccatcttgattttctccgttctcccctgtataatagaggtgtaaattaattttcagttaccttgattccctgggagtagccgctcctggggtttctactttttcagccatatcaaccatggtaaggcctcttagaatggcactaatccattgattttccatgctccagttaacctgaactggtccgtgatcatcaatagcctgtaaaatgatctcagctattttccgcttgtccatcacagatcctccttaagagccttctgaatatctctgatatatcgtctgatatctccagttttctccggacctagatctgcacttaattcctctacttctttagcaatggtagataataaatctaaaaggactgtctgcgggtaatactttttaagaagcacgccttcttctgttactaagatttccatgggggaaccttcggtcactcttatgtttcgccgtatctcccttggaataacaatcctcccaagatcgtcaattcttcttatgatgccagttgacttcatgatttttctcctttcttatcatcagcaaatggatcagggcaaaacaccttatcacgccatgtcagtttcttgaaatttgcttcacacgttggacatttgtggcctacaataacggcatctgccgcaccgggataataacctcccaagctatcacccatctgatctccacatcttgcacaattaaaatatccgaagcaaaatgtctgaattttactgtgcccgataaggctacaggtaatttctttcttctggtcctcatcagtaacgcctagagcatctagttttttcagtaatacttcttcactctgaatttctatctttgccatcttccctcacctcatctcaatcttcatcttctgttccaacaattcggccatcattaatacataccggataccagttttcaagcataatctgtttgtccatctcaaaaactggaactaaattgatatctgtctgctctgcatttgtaaatctgctcattttccattcacctcctccttgtccatcgtgcccgccatatcaggcggttccgctttgcttttccatgagctgtctttccaatgctctggatacaattttccccgcattttcgagaatctctttttttctcacttcatcgacaaggtagtcatcatgaatttcaattgtacaattatcaaacttgtattcctttactttcataaagcacctctttttaatccctttaattgatactatgtggtacggtttgtacttgtttccagccagacactacgtccttatataatgagttcaacgaaatattggcaactttactgcaaacacagcaaaaacgaatcccaatatgatggtatacagcagtcccattctcccccaacctacctcgctgtgaccgtgccaatatgacatgatacacaacaggcaggtcattaaatacacaggtactatattccaagcattcacagaattaaatctcacctccccgcttatctccccttttttcattgacacgtccatatgatagtggtatattataagcattcgaacgtgtgttctttgtattaggctgacaacttctctttatcaaacaaccagttgaagtcatactcggggaaaaacactttcttcattagtagcgcctcgctaacggtaaactctgtttttaccactcctttgcacctctctgagactgtccttaactgacattgaagcagttcagatatttgcgtgaacgttatttttttctcattcattgcaaacagaaggtttttatacatattctcacctccaatcatctgcgcaactgcgctaaccttgcttatatgatacgctcaattgcacgtattgtcaagggctttattcgtgcaattgcatgaatattttaatccatgatcacatttgcgtatttgcgaaaattttgctttactttttgcgtaattgcgcgtatactattattgtattaagtgaggtggaaaaatggaaaaagctagaatattagaaaaattgattaatgatactggactcagcaaaagagcctttgcagaaaaatgtggtatttcagagagtactctttattctattttaaaaagaggtgtcggtggagctagtgttaacatcgttatatccatttgtaaagaattgggtattactgttgaagggttagatgaaatggcaaaaggtgcagcaaaaactatacatgagccgacttatgaagacatccaaagtcttatcgccaggaacggaaagaaactcacgcttgaacaaaaacaggacattataagaactctactgtccgatgattaaagggtgattttgttggagcaatgcagaattattgaaaagacattagaagtgtacaagaaatgcaatattaaaagtttccctattgattgctttaagattatcaaaggtttagggattccattatacaaatattcggaactccctgggcctaaagccagaaagtgtcttttggttagtaatgacgcttttactcttcaaggtgtaattttttataacgatgaatttccccacaaagaacgacaacgtttttcattgatgcatgaagttggtcatattgttcttaatcatgtgggagaatgcccaaaaaatgagaaagaggctgacttcttttccagtaatatattggctcccaggccaatcatgcagtatttgcattgtgaatcggtaaaggacatctataatacatttaatgtttcatgtatggctgctaaccggatagcaagagattataaaattgattatgtaaggataaagagcgatttacataaaagtatttgcaactggtttttcccacgtaatatttctgatatcccaatccaaatagatccggtacctgaatgctcaacatatgattccaatttctttagtactcatcgatttcttatgggtgaaggatatatttttgaacaagcggagttttaccatttgcatggtcatgggttttaataaaaaaacaaaagaaagaggaaaatgagtatgattgattttaaaaatggatcctttgtaaaattaaaaaaagtagataattctatagcagatggagttaccaagctttatatctctggtgaggagacgataggatgctacaaaggaatgcgcgattatgttgtttttacgaataagcgtattatctctgtaaatgttcaaggaatgacaggcacaaagaaagatttcacttcgatgccatattccaaaatacaagtattttccgtagaaacatctggggtatttgatttagacagtgaattagaagtatatttcagtggcgcaggtaaagtaaaatttgaatttacaggttcatgtgatatagaacgaataggtcaacttatagcttcttatactttatagactaataaacagcaaaaaccgcccagtgctaccaacaccgaacggctttgcagagatactattatccggttaacaccagaatatataataccagtatgacactcgcattataacatccttggtgcaaccggtcaatgggtgttatttttatgcccttttttacgtacatttaacaaggagatgatacaattgacgctagatcccaatggtaagtattatatgtacttacgcaagtcacgtgaagatgtagaagcagaggcacacggagaaggcgagactttagctagacatgagaaccgtttgaaggagctcgctaaccatttaggaatttcaatttctaaagtttatcgcgaggttgtgtccggagaaactattgccgcaaggccagaaatgatgcgtttgcttaccgatattgaaaacgatcaaccgaatggtgttctagtcgtagaactggaacgtttggctcgtggagatacaagggaccaggggctcattatggaaactttcaaatatggcaatacaaagataattactccgatgaaaaccttcgatcccaacaatgagtttgatgaggagtatgctgaatttggacttttcatgagccggcgcgaatataaaacaattcgtaggcgattacgagatggaaaatacaacactgccaaggaagggaaatggccttggggaaaagcaccatttgggtatgaacgctataaactaaagggacaaaaaggctatagccttaaaatagttcccgaagaagcagaaattgtgcgtttgatttatgctatgtatactgcaggaactccagaaacctataataaacctatcagtgttactgctatcggtaaaacactggacaaaatgtttattaagcctaggtatagtgagacatgggctcataacgtcatacgtgatatcttgcttaatcgaacatatattggagaaataccagctggcagacgcaaaatagtcaaggtcatgactaatggcactgttaaaaattctacgccaatcaacaaagattgtgattattttcctgcattacatgaacctatcattgataaagaaacctttgatctggcacaaaaagtattcaattctcgatctaaaccccctgtttggctaagtggaacaatcaaaaatcctcttgctggacttctaaaatgccaaggctgtgggtatacaatgattcgccgtccagttagtggaagaattaaacaagaattgttcttatgtaagaaatgcgatatgcccggagccgctgttgatgatgtaattgataaattaatgttagcattgagatcttggcttgctgattatcgcatctccatttcctctcctcaactttcagttgttggaatagctattacgcagaccaaaataaatgagactatggattttatagataagcacaaaaaacggttagacaaggcatatgaggcatttgagacaggggtctatgatgcagatacactgaagaatagggtggaaaaataagagaggaaataattccgcacaaaatgcactagatgaactacttaaacaacaaaacgccaagaggattttgagaaaaaagaacacgttgctaataccgaaaatagagtttttactagataattttaataacgttaacaccagaagaacaaatactttattaaaggaggtcttggaaaaggttgaatattcaaaagaaaagcgcggaaccaagaaagaaatcccagattttaaccttaaaatttatccgaaaatttagtgtgtcaaatactgataccattttagcatatactcattaacactaaattgatatcagtgaatacactgtacattattattggaattaaatagcaatttaaacgctatgcaatttccccttgtttacatgggtaaaatcactggaaatttaagccgtcttgacataaacccaggctattacgctatagatgccgctagcacaatatcaggtgcgccagaagggacatcatacacgggatttatacagttgcctgtcgcagcatacagaacacagattattttgggttttgccgataacgggataaaagtcaggcaatacgttggaaatccggcagcttggttttcatggaaatgatcatttaggcctttttccacatacaatacacattcaagtcttgactggatatggtagaccctgacaagttcgtaaccactattgtttgacggtaaatatgctttattataatgctttgtgtactcgccccgggtaatgcgaacatggtggatactaataagtatcctgttttatctggtattacaaattgcgcacttgcgcccgtagccagtgacgatatggtaaatggtacggtactgtccgtaaatttattttctaaattgctatttatttgtgagaataattccgatgaacgaatagtaatactactaattctccttgcaatgaatatagtacccgccacgaatcatagaaacttcagcaatataaggtatatcattaaggtgaaaagttataggcttttgtgtatttataaaaactagtttctctccagttgattttgcatacttttctatgcatgaacagattacttttgtagatggatatgttaacgactcttctaaatcaatatgaaaaccttttttaaacataaaagctcctttcagtgaattattctcacatattgattatacaaaactataggaataagtcaaataatgcaattaagatttaactgatttatcgtacattgaaaacttaatattgatagttagtaggtatggtgatattctactcataagtatttatttcaaaaacattgggggagtcgaaatgaaagtgggagaagtatgtttattgacaaatgatgttatccgattatcaaatttttataaaatattatttgatatcgataatggcagtgacgataataatcaccaatttatcatatcggaggatacaacactgactgtttataatgacgggatagagcgagatgcgaacctacataacatctgtattgcttttacagttgatgatgtagatgtagagtttaagagattaaaagcacttggtatccaaattattgaaccaccaaccgtaagaccgtgggggcaaggaatatgagctttttagaccccgataataatttgataatttttaggtgttttccccaaaaatagaacgataagcaaaaaattaaatacgagaaaactactaactatcagtattaagctggtagtttttttgtactcagaatgaagcggtttaatacagaactgatatttatgaatgtctaaataaaaaaggccatagtctatccacatatgacagtctatggcctttagatcttaaactggtaatggcgatttaccagtcatgttatattttttattccaactatcttctgtacttttccatacatcttgttgaccaattttagctttaatatctgcattctccaatgcttttgccacaataggtgccatagtatttgccatcttctcataatcaatgattccggataatgctgcattcaactctgcagatataccggccttaaaatcataagaaggggtatcgtaggaaacagaggcttttgtatctaccatgtcaaagaattccctgctgacttgtacgttggtatctattgatggcagagatatatcataatctgtcagtttgtcagcaaaagaacctacttttgaatatatgacaccaaatttatctataataccattcattagtcctacagtaaagtagtcaccaatctgaaacgccttttttgacggtgagtgctcatcaaatccttttttaaacccatctattacaccttgggcaaaagtagcaatgccagttcctaaccagtccgtcaaattcgtaatgccttcccatagacctttaatgacgttttcacccacagtaatcattttcttcggtaattctccaaaaaactctattaccttgtcaatgatagttgggacctctgtcttaaagtatgatatggtattggtagaccatgtagatattttctcttttatttttattatcgtatcatatatcttacccggcatttcagagaaccatttcacagtgccggcaattacttctgatactttctggttaaatacattgtaagtttcagtcccccatgttgcaactttggttataaatgtagaaattccagaatagattttccctggcatctctgaaaaccatttcaccacagaagctataatttcaggtattttctttgataaataggtgaataaatccactccccatcttgtcacagttcctaaagcatatcctaacgcatatccaagcttctccggcaattcgttaaaccaatcagcgatatcttcaatgacactgcccactttttctggcaggccagtcaaatattcgataaaaccatcccacttacttgaagcagtagtttttacaagttcccatacagaggaaagcttttctggaatagattcaaaaaacggaattacagtatcattccaccacgccggaactgtctgcgtccaaaactcttttatttcatcccaatgagtgaccgtgtaaacgactccagctactactgctgccacagccgcaactacaagagcaccagccgcagctacacttatcccaagtgctgacgcaagggcaacaactccgcttactatggctgttcctaacccacttattgctccaactattaatccaggtattgttgttgtaaaaaatgtctttatgggaacccaaattaaccccattaatacagacggcaaagaagcccctgtttcagccatagttgtagttatcgtggttataatggcactgcttggaaatgccttggccagtaatttcccaataccggaaaaagtcaatcctttactgatagaagtcattatctttgcagacagtaactttccaagccccgtaaattgtaaaagtccaaaagtcgtaagaattgttgtttcaactggtgctgcactaaaagatcctttccagagatcaattccagctcctatagctttccatatggcttctcctactttgccaccgatttcaagaaaatcaatggattcaaggaatgtacctatcttaatccctattagagaccaatctgtattatccagtgctgctattaatgcgtctaatagacctttggcccagacatttaaagtggacccggcagaggcaaaatcaaacgtagtaaagaaattgttaatcccactggcaattgaattgcccaggttcgtccagtcaaaggctattccaaaagcaagtgccgcgtacaaggcagtatttaaagccccggcaatcgtcttacctacagctccaaacagttctggtgtaataaggccgttaaagaactctgcaagccctgtaccgaagccactggcaatagaataaacagccggccagtttatgttttctaatgctccggtcaaaccatcgctaatatatttgcctatgccaaaataatcaccagacttgaacgcatttacaatcctgtctgccatagcctgtgcattgttttccacattagcaaaagcaacatcccatgctttctggtattcagaaaacgcgtccaggaaagcgtcatctaaaagattgccccctgctccgccggaacctccagaaccaccacttccagcattacctgagcttacaacattcaaatcatcaaacccctgaaggttatcggccatcttctttgtgttctttcggcatcacctgtgctgtctgcaatgccgtcagctgcgtcctccatgccacttaaatctgtagccgccgaaccaatagaagaactaaaatctccaaccttgattcctagaagacctcctatccatgaaaataaccgctgtacagctattaccaaggcattaatataaggaagtactttcgcaacaataggcaggaacaagttgcctatcgtccttgcaaggtttgcaaaattagattgcagaagtcgtaactgattcgagggcgcatcaagtgtatttgccaagtctccccaggcgtaacgggtggaatccagtaatataattcctctcaataatgccttatcctgctgatttaaagcagttatttttgcattaataccgagatcagataatttctcttgtagatttacattacgaatattaacaccgtatttatctagagtccgactcataccgaccatgccggaagccatatcttcccatacatcttcaaacttcatatttcgtacagatgcaaggtcagctcctatcatagatagagcgtttgatagctgcagggccgtttcagaggcaacacccatagaggaagccatctgtccaaaagtagcttgataattcataagcctttctggatcaataccaagactaactgcgccggtagatttcaaattcccattctcatctgccatgaagccggacattttcccagttaactcctgtgcacgtttactaaatgaagcggcataagcttctgctgattcatagccgaacttctcccaactttttactccagcgtcggcaacttgtccccacgcggcatcgaaatagtttagggtttctatgtaatccatagatgattctgtggctttccataggcttttcattcctcgaattatcatgaaccatttcgcataaaacaggccaatctgagaaacgagtccttttgtgcttttccctgcccttcctgcacttcgagaataagtatttagaccgtttaccattgcgcgacttgcacttgataccttagaaccattggaagccaagttggccagtgcattggtcattaggataaggttttggctaaccactggtgcacgggataatgttgccatcaactgtgacaaggctgtgcctaattgctgaatatttggtatagccgctgtagctgtctttcctcctagttttgttattgaagaaacgagatttgccagcccacttgtatcaaaactgagcgcacctatcccgttcatgccacttacaaaccttaaaagctgatctttaattggcttaaggtttgctgcggcctgtgtggcctttgtgccgcaagacggctaatattgtttacaagattattcagtccctcgatattaaacgaaacactaccaacggaattcatactggatacaaaactgtgcagagaagttgaaatctgtggaaggttctgtactgcctgtgtggcatttacaccacctaatctgcttattgaggataccagtttatagagagaatccggattaaagttcagactaccaacattgttcattccagaaacaaaatcggccatactggtttttaaaaactccagattctgcgttgcttccgtgaccgaagcacgtcccagctttgaaatggaatttgcaacattagtcagagtttccgtatcaaatttaagatttccaataccatttatactatttgaaaagctttccatagcgtgagccgtattgcttactccttgaacatcaaccgccgccagtttattaaggccactggtcactctggaaaaatccgcagttttagtccgctcattaaagccttggatagatgaagcaatctgatttattccagaggccacctgactcgctccggacatttctatcccggataaagcagattgcaggctcaacatcttttgtatgaatttgtctattttagcgtcagcactggtcgtactggcatctatttggactttcagatcgtcaattacatcagccatggtttcaccgccctttacacatacaaaaaaaggcgagtgaattttcgtccatcactcgcccttctttttacgtttcatatcattttccattgttccagcagcaaaaatgaagccttgtaaggctttttcactttctgaccgcttttcctcttctgtctttggtgttacacgtatcggttcttcaaaatacttacctttccgctttcttttaataaatggcattgcattacatacagtagcgtccaaagctgaagcaacatactggcccatgagccacatttcgtcactacgttgttgccgctttcttcgaaaggcctctacaaatggcagaagcttccgaggatttaaccgccagaataaatcatacggaactcccatatttaatgcttctggcaaatactgttcccagattattttgtggaagttgatttccttttgtgatcctgtggaatcttcccggatttggacttctgttcttccgccgcttcgctcatctgagcaattaccttgtccattccggtgagtttgaaaaaaccatcttcttccatgcagtctctcaggaaatcatacattccccagaatgaagcacactcatcatctggattctccttgacaaactgcttaaatagggctttggctgcctgttcgttttccaccggattgttttccagcaagccggcataaagagccgtaacagcgattttgggaatgtctgaaaccatatcagatgttccattcaaaatggccgttgcaacggatatcttttcattctcatcagttggaccattcttcataatgtaactgccagaaatgactttaaatatactgtccacacaatctttatactctgcagcttcaaaggaaaattcactttatagtccttaccgccaatcgttaaaatcctcatattttaatacctcccatacttatttattaaggttcttccgaaggttcagttggtacaataggatcatcccacccgatttctccggttggcgtaacagatacactggtatcccaagcattgtcaacgtcggaagccgcccaacctaatcttgctggcacgcaagtaaagtaaaaagcctttgtcagtctcgggtgataaaactccagccacatacgcttatttgattcttgagccgtatcgtactcatcacaaagatcttcccacatatccaggaacacctgcgacataccaaacgtgattgcaagagctccgcccggatctttcagtccatcaatataccgtttccagatggtatcgtttaaagatgttacatcatagctgcccacttccggattaaagtcagggatacttttgggattcggcagatcagtaaaggctgtgggctttgttccagctgttgtttcgatcccatatccgacatggataccagcagttgataaatctacagcttttgccataggtcatatcctcctttttgcataaaaaagaacctcgccattagacgaagctcaaagataattgctcatatttttatatcaaatcgccctcgcaataggtcctatggaaccttgcaatccaacgataggcttctgatgtgcttgatcggtctacttccaaaggaccatacttcaaaatgaatcctagttccatcataatgtcagcggcaaggaagatcaattgctttgccttactggaagaaccggaatcataaatggtaatttcaaaatcagcagatatggcacactgcttattctgtagggagctgcttgttgtcggctgtcccaggcttttgaaataaagatagggaaaagcggacggcttctcattttttgttgtgccactctctttgatgtatttttttattttctcatcactcaccaaccgggtataaaccagagaagaaatatcaagcattactggaacacctccttatgcgtgatgaagacttcttaaatcaccatcataaaacaaatcactcggctctctaattccataaaatgaatatcgcctatgcactcgcttataagggactccatatatctcacaccattccgcaagacatttatctacgccgtttattatgatccttacattgctggttttatttcttgcctgttctttcattgtaataaacatacaattatctgggctataactttcatttaggtttcttctctcaatactcaactgaggattccatccattttcatatgcccattttgcaaaggccttaaaattgtctatccattcatcacaaaccccaattcctctggcaccatatgtataatatctttccgactttttgtcatagcacctttgcttcatatttttccacacattgtataatttctcataatccacagaagtaagccctaatacatttttacccaaacaccacatctccttatataaaaataagacacgacatttcaccgtgtcttaacaaaaaaaggacatcaagggtacaccctgatgtttcttcattttcttagccaaagatttctttagctactacctttattttttctcttatctcaactgacgctgaatacattggcatcgtagctttgacaccatatgaatgatgccattcgttatcctctccaaagtaccaccaaccagattcattaaaagcccacttctgtcctggaaatgtacctacgcccataccaaattctggtgctttgggattttcagtatgattgtagtgtatgccactcccaaattcaacgaggagcaaggtgtttatggttccgtagtcattggacttcgtttgtccggtggctacaagaatagctttgcaaccgtctgtcctaggctccatttccacccgaagagtaattgttttacctaagggggattcgctgatactttgtagggccacagtctggccggcttctgccagacgctgacatagtagttcggctttcctgtgcaagtctgctttatactgttccaactgattgataatatcctggattccttttgatgagaagtttcctcggattactttcttgctcatgatttattccaatagaggagacaatggcccgactttttcatatgttgcttcgaagatatcaggcttgcacgggtataattcaccctttacaccttgaatgatgtaatcgcctacgctaacgtgatggtcgccctccaaagtcttaataaagcactcgtccttatcatcaaaataaattacgccatcatcataagcagatatgccccaatctggaacacctttacagtttgctccgactttcataaaatctttgcaaaattcaaatgcttcaatctcaacaggtttctttctgtatttagccattcgctgcacctccgtctggcaactgtttaatagcaaaaagcacggaattaatactccgtgctactttaacaaccttataatctgctcctttaccgccctctggcttccggtcaacaaatacttgtgacagttcatcaatcggcaacgtaaggtcacaggaacaaatcactttatcataatccgtattcactccgaaaggctccgtttgggcttcggaccgggccggggacacattcgcccggaactttaccgggtctgcatatccaaccgcataatcacctgtcagaagcggttcgtctgtcaccgggtcatagatgatgttaccgtccagatcagtttcatagaccggaatatgattactgtagagctgataccaaagtgcctttttattgcgttttaaccctcgcatgtttcctccaaaagaaaaacagctaattttattagttgccttactttttataaaatatcagtttgtttgattctctcatatgcatcgttcaagtgattcacagcatatgcatctgcatatttttcactaggtattgcatgatattctgtaaaataccttataagcaattgcttatctttataagtaaatcgtgattttccgtctagcttttgcattatatcttgtt

SEQ ID NO: 11 - DNA, 10289 bp, Clostridium indolis WBS-01
cggatcccctgcagatatgtggggaaatacactaaatgcagttgccgctactacatcaagaggacaacaaacgtttacatcatctgggacatttactgttccaactggtgtgaggtctattgatatatttgtagttggtggtggtggcggtggaaaatcaggtgttggtagtgctcctggcggcggcggtggtggtggatacacaaaaactgtacttaaatatgcagtaactccgggtcaatcctttgcagtgactattggtgcaggtggaagtccggcagtagatggaggtactacatcttttggttccgtggcagccgctgaaggtggtaagggcggttccctttattggggaggaatgtggttccggtggtggtgctgctggatatgattggggggtaatgtggttctaacggcggcaatggctctggaggatctgaaggcggtggtggcgcaggacaaggaaccactacgagagcttttggtgaatcatctaacactctttatgcgggggcggaggcggtggcgcttatgtaactaacggatctggcggttccggtggtggaggtgctggaggagatgtatatgatggttggctgtagctggaactgcaaacacaggtggtggtggcggtggtggcgctcaacacggtacggatgccagtaatgcaggaaaagccggtggatcaggaatatgcattgtaagatggggatattagaaggaggaataatatatggttgcacatcaagtattcgcacagatatgcgaaggagaaataaaaaatgttatcgtatgcgataattatgaaatggccaattggctggcgagagcatcttatggaaataatgcattcgcgattgactgcctgcaatatccctgcggaataggtgataagtaccatgatggggccttttatcatgtaggcaatgatgggaatgaaacagaggtgaagcccgttattacagcggaacaggaggtacaggctctgaatgctcaggtagcgtatctgtccatgatgtccgatattgatatggaaggagtctaatatgagtaagaattttgaaaaagtaaagggtttttatgatgcagatctgtggacagaggaatggtgtggaatgctgtaggccgctggattacagtggaggaataccaggagatcacaggggaagaatataagaaagagtgagaaaatgagaatgaaaaatattttatgtacagccgcaggagctgtgggaagctttatagtatcattatttgggggctgggataccgggatcggtaccctggtcctttttatggtcattgattttctttctggactggccgtggccggagtgtttaaaaggagcaccaaaacagaaaccggagccctggaatcaaaagccggctttaaagggctatgccgcaagtgcatgacgcttctgtttgttttggtcgctcaccggctggatctggcgattggaaccacatacataagggacgcggtgattattggattcatggcaaatgagcttatatctatcgtggagaacgccgggcttatgggcttgccgcttcctgccattcttgtgaaagccattgacgtattgaaaaagaaatcagaggttactgaataatctgttgcgatatcgcaacgaagttgtaacatcacaacttttcgggctcgggtaatcctgggcctttttctattgaaaggataaggtgatttttatgagcgcagttgagaatctacttcaaagcacaagcagaggttggatatcttgaaaaaaagtcgaatagtcagcttgacagcaagactggcaatgccggggataataattataccaagtatgcccgtgatctatatccctcccttcaggcgcaaccaggtgtgatatgttcgtagattggtgtttcgtccagggatttgggatggaccagctaagcagctgctgtgtggtggattcagtgcttacactcccaccagcgcgcagtattataaaaataaaggacgatattataaatcagatccactccctggtgatcagatattcttccggaacgataccaggatctaccacactggaatagtctataaagtaacgagctcaaaggtctatactattgaaggaaacaccagcagcggatcggaagtaattgccaatggcggggcagtctgccagaaggaatatgctcttaccaatagcagaattgacggatacggacgccctgactggtccctggtagagcaaccggaatatacaatgggctggaatcacgacaagaatggctggtggtatgctgactcgaagactacctattataaatcctgctggcagatcatcaatggccataagtattatttcaacccggacgggtacgcggtcaccgattggcaggtgattgattgccaagatttctattttgagccaagagccggacacccgttggaatgtgcgctgtatgtatcagatcgggatggtgtgcaggggccaggaaaattttaaagccggtgatccaatcagagtgggcattacggtggcagggactggtgtaaggccggggattaaatttttctaatagacaggtatttgtccaatctatcaaagcatataagtataataagaattatcaaggaattaataatatgcaatacggttatgatgtattaatatagatcgaagtagaagagggaatcaaaaaaaatattgggtgcaacaggaaagttctggggcagatcaagatatggggaccaaccctacaagtccagaatcagaagaaattgagctctcaaatccttttcccgcatccgtaaacacgatcgctggagttgttgaagattgcatgaataacatggttttcattcggctaaatagtggaggtggcttttggatgattcctaggagcagtactgataaatctgttactggccaagtttgggatttagtttttggctggaaggaagacgaaatcagcttttctgatattcaaagtattagatgcatttcgtaaggttacgcgatgcagtaaagtctttaagtattgtaaagaagaacttaataaaaacgttatgaagggcgggtatccggtattccgggcccgcctataaagatactttgacaatctgccaataacatagatgttttagcccttctagcattaaaagggaaacttctgaatgtaatattgcgtattaataataaaccacatttgggtatcaaatctcataatagtccagagagataaacctcgaagatcatattctgctaccagcccgactcttgcctcaaaacttctcgcatcattaaaccacactaagtgaagaatcccgtcactatccatataatagaaaaaaggtgactgtgctgcttcgttaaattgtattggtatgccactatctgctgcaatctgtattgcattattgttttctatagcagttgcttctgttgcgcccggaacatagggtagcgtccaatcatagccgagtgtggtgatacctaagaataataattcggatggaataatactggttacgtagtctattagttctcttaaaacattaactgggaaaattgagcttggataactataaaatctggcccaatcatatgatgcaaatagaattccatctacatatccagacaattgtgaataatccaacttttcaaagatgacaatgggaccctgaatgtttataattggcgttgtggtgactataactctataaccttctgaatgaaatatggctgaagccttttttacatattccacaatactatttatgttatccggtgtgatatcttcgatatacatatttactccgtgataaccctttgtttttattatttgaagaatattgtcaatgaggcgatcttgcacagaggggttatttaaaatattctgagttacttcacgaataattgttccttcttccgtaattgtagaaaaaacatcatgggcacaacaccataggttttagccaactgaattacatcagagtcgtcagcaatagagataacttctccctcacttgtggccctataattgaatatcgtcagatatgttaaaaagggaagcgtttttattaaaatagatttatctatatatgaaaaagtataaccactagtggtaattgttcctgatttattcgtttgataattaataacaatggtttcaccggcgtacataagttctctatcggaaagataggggttatttctcaataattccattggcgtagtaccatgctgctctgcaatactttccaaagtgtcaccagcctggacagtatagagtgtttccggctgaacaatcacaatagtttggccagttgctaaattgccagggtttataattccgttttccaatattaatctgtcaacagggatcttgtaataatctgatattgaatttatggtttcaccgggttggacaacgtgtatgatcatggattccctcaaatgatcttattgatactattatatgctaatcttacatgttcataacatcgtagtgtagataataatgtattacaataatcttatgcaatatactggtttgggaggttggatagttagccaatgaaataggcgggtatccggtacattctggacccgcctttttgcatggtagaattatatcattttctgactgcattttgactgcatgacccctgattttgactgttatcaaatggtcgttgttggtgaggttaaaagttacaagaatctcgaaaataagcggaaaagtacagatttacggacttataaatatttaaaaataaaacccttgcactttgctattgccgatacatacccatgaaaccctttgtttatgcgtgtttcatgggtattacttttctctctgactgcattttgactgcattgtaataagcctctaacttatcaacctttacatctgcgtatccgaaatgggtgtaggtatctaaagtggttttgatatcatcatgtcctaaaagatattgcgcttgcttaatatctactcctgccttatataaatcactggcataagtatgcctaaacgtatgcgcggtaatatcgtcagggagaggcttgtcactaaccgcctggagcttattgataaattgcttccagcgcctaaaaaaataatttaacccgatatagcttccatattttgagggaaataaaatcccgtctttatgggaaatataatctttcaaaatagggtatagaggcattggtatgggcacctgccgcttgccagctttggttttggggtagtcttgtaagcaatcagtaacgctcttacttgatacaagggtcttgcagacattaatctttctcttcttcaagtctatgtcagatacattcagggctagtgcttcgctttttcgcagtccggtgtagagcaggagatttgcgaggcagtattcaaattcgtttaagtctgctttttcaatcaagtctcgctcttcttgagtgagagatcttctttcttttctgtgataattaactcgtgacattccacctgtaatatcctttgccataatatctttgtggactgcgtattttataattgcccggattgtggataaacatttattgtatctgtctaccttcccggattcaattaatactttacggaattcctcaatgtgactctgcttaagattttttactttaatatctccaatgtaagaattgatagttttcagccggcttttgatgactgtgattgattgctccttaacgcttcctactttttcattcgtgagccacaggtcagataattcacgaaaggtcatgttctcctcttgcaagataatccctttgtccttaagactcataaaatccctataattcttgtccagttctttttgtgttttccatatatggtttttcggattggcttaccgttccttagtcctatggtcacctgtttggagtatcgtccatcctttcttttcttctttttctcagccataatatcattcctcctaaaaatgggtaaaataaatacgccctcttgccagagcgttccagaaatgatataattccattgatgagatggatatatctttccggaagtccggtaagagaaaatctatgtaaagccgttcagcattgcgagtgctgggcggtttttcgtattattgattaagcaactgttttttctttgtgtcgaattcttcttgagtgatagctcccatatctagaagctcctttagtgccttaattcctttaagagaatctgatatttcttttgatgaagaagagattgaaagttctttctctattttaaaacactgaatttgagaatcggtcttcgagttgcaggcgatggtaattggaaagactgtcccatcgcttattctttgtaatttaagtatagctgtattatctttttcaacttgcttatgtacttgttgtgtagcagactcgtttgtggattgagtctttgccttgctttttcctcctgccccaatagcagcaccaacaaccgtaccgacaccagggaaaagcactgtgccgataatagccccagtagccatttttcccgattttccttttttggttgtttcactgtttgtagagccttttgtgttcgctgtcatcacagaatcataagtaggtccattccaatggtaatctacaatcttataaatttctgaatcgtcatagttaaagtatgtggcaccgtctaacttctggcgaagtgtggcggagggaccgagtccaagttctttaaatccaaaagacatacttaaaggaatacttctgtcttttgagcactctgcctgtttcaaggcctttgctttagtgttttcaatttcatttttggccaaaccaaccagattgtccattatccccatatttattacctcttttcttttttatctatttacaattttctataaaatcacagcatttttactcacttgacattttgcaaatattaaatggctcaaataatattatgtattcgcctttttgaaaaccaaggccatactttgaacgataacaatctatggcctcttgaagaaaagattcagttacattaagatgctctgcgatttcataccggttagagcaaccagcttccttggcagaaattaatttttctattgtaaccattttattataggcccatagccttgcggaattttcctgtttctgattgacagcactttccatatttaaaattataccagaagaagtatgaaagtgtcctaattcttctgcaagtatacatgctctttcaacacacgtatcaatgtgattactaattgctatagacccatcgcagtataaacctttaatattttcgctcttaaaagggacataatcgatttgtaaaccgatgtctgtcgcttcctgttcttctttttctaagtcattcattactctgtagtccccgtgtaatactattttttacgtctactttttacaaacgcaacataattcataatttcttccatttcttcctctgaaagtttttctccttcaaaatgagctgctagggtttcaatccgcgaagtttcaggattagattcttgtcctgttagcaggaaatcgacagaaacgcccaaaaattctgcaatcttttgcaatttgtctccgctcggcatgtttttattaaatttattaatggagctacgagcaaacccgagttcttgttccagccgattgacggaataacctttcaatttggcagtatcacgtatacgttcatataatcccatttttgtatacctcaaaattttgcgcaattaactattgacattcgcaaaattttatgtataataaaattatgagttgcgcaagattttgcgaatgtcatgttgtaagcgtatattcttaaattgattattggcacttctgattctagaatattttacgcaaaatgtcaagctaaattcataaaatattacgcaactacaaaaattgtaggaggtgaagctttgctatatgacaatattaaggctctgtgcgataaacaaaatatccctatttcacaactagaaagacgccttgaatttccgaggagcagtatttgtaaatgggatgaaaatgaaccaagtgtatggagggtgcacagagttgccaggctattaggcgtaaccgtagacagcttactggaagacacccaggacgcgtaacagcgcatcgaaaaagaggaggcaagactggacggtcggggccgtggacaagcagtagaaaggggaggtgagagagataaagataaagaaaaacagcctcgcattattattaacactcagctgctttttcattttgaaaatgatttttggctttgatggtgagattctttcaaagtatcaatcgtctgtactatttatgcttgtctatttatcagttcataagcttttggattaaggctgatattaaaacttttatttctgttgaataaaggctgattgcaagggataaaagccagccgccaaggtttataactcttgaagctactgcagagggattaaatcctatcaattcaattaaattgcttgggaatgaaaaaagtgtttttaatgtccgtactggattaaaagaagatttaaagtcttgaagaagatagtttcgtttcatcagcagataattgcaaatatttatagcagctctataattttctacatcggaagccccatattcaagtgaatcgccataatcaccgtagtatttttgtatcgttgggaatttaagcagggtttcattaagacattgttgataattttctttcttatcaaattgaaggcttattctatctattcttgcggaatttatgtatcttaatagacactttaaacattttaatatttcgttaagcttcataaatgattttacaattttaacaatgtatgcagtaacaaaaaaaagcagtaggaaaaactttaatgaaacattgattagaggaaccatttttttctcctatcatatatattccagatggcagtctggtacttacattataaggagaaatggaaaattttacaagaaaggaatggtgatacatatagaaattacatattcatgcaagtcctgccggtaccgcaaccgctgtctggaacggagcaggcggtatccatgcaaagattatgagaggagggaaaataaagttggacaagcaattcctaacaatcaaggactgcgtagagcgccacggcataagtcacaacacaatagagtccctgtttaaaagaaaaggatctccagcaatccgcgttggccgtagatggcaagtggatgtaaataaatgggatcagtatctgctaaaattggcagaagagagtaaggggtaaatctcatgaaaaagtactatgacaatttagatgattacaccgatcacagcaggcacccactaatggacaaagccatatgctacgtccggatgacaatcatatttttctgttgtctggccgtgctgtttgcggtatgtggctcgttggaagtgatgtgagaggagagcaattgaaatatgaaaaaaattaacaatattgacttgacagtaagcgcaggacgggaacttgaaaattacaaggaatggattgataaggcagagactattgaaagagcaaaagcagctggaaatgctgcacttggttttatcaatggtatgaacatgacagtcaatgcaatgatctgtactgaaaataatgattttactggtgacttcggtgaatggctggatgaacaaaaacagttagtcatgatagcggttagacaaaaatgtttcatgctcgttgatgaaatcgaaatttaatgagaggaggagaggggtcatgataaatgaagatcgtctgaactattacttaacggaattgcaaaaccggaaaggatcgccttacggcatggctaatgaagcacttgcggatgaattatttccgtatgttcaagcagagtttccggaggcaatcatggtaaagcagggaatcggccaatacattgtagtgactaagcgggccagaactgcattgctcaaacggtttcaggtttctaaactggagtacgaaaaagcaatttcagaaattgatggagtcatacagactctaaaaactgaaaccccaggagcggcaactcccagggaatcaaggtaacacgtaaatatttcacatccctattatagggaatctatcggaggaaatcaagatggaaaaaaaataataatggtatatgttcctttgaatgagtacgcaaaaggacaagctgccatagcgaggcttgaagccttgaaatcttttactataaaaagtgattacagcatttcgcaggaggacattgccagtattttggggtttgagctgccggaaaaaaggg
